United States Patent 7,919,608 (NUCLEIC ACID MOLECULES AND OTHER MOLECULES ASSOCIATED WITH PLANTS) - sequence listing, part 4

SEQ ID NO: 15641 - DNA, 624 bp, Zea mays
  Clone ID: LIB3279-226-Q6-K6-E4
gtcctgacaatttctctttaaccaagtcaatcttcatttgattcaaaagtaaagaacgtatctcggttttcagctttcacggacaattttgtagccatgtaatgctcaacacttccttcaagtgcaccacattctttaaccaaattcatcgccttcttgattgactttatctttaattctccctctaggaccctttttgcagcatcactattagactgcaaagttccccacatgcccctcataagcttcaacatagggctttgtcctctctttaatggacttgttgcagtactagtgatgcatgtccgcttctttcttgctccactagctggactgacaatatcctcatccaagtcatcaccttcgtcaccttcattcatatgctctacaggaatacaagacgatgaaccaacaacaacattgtgctcatacatttgttgaagttgatcatgattttcaggtggtccatattgtaacttcttccattcagagtgatcctggcaaaatcagaatgattagtacctttgtgtgtcacaaaaaacacaaacagaaggcacgcttcatgagtacctttgtgttttcgctccagaaagcttcattagcaacaacagtaccatttgcccg

SEQ ID NO: 15642 - DNA, 493 bp, Zea mays
  Clone ID: LIB3279-226-Q6-K6-E6
ccctcttgtcacagcaccccccaccccacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagact

SEQ ID NO: 15643 - DNA, 606 bp, Zea mays
  Clone ID: LIB3279-226-Q6-K6-E7
gctcctcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgtaacaaggttgccggcttcaccacccacctgatgcgccgcatccagcggggcccagtccgtggcatctcgctcaagctgcaggaggaggagcgggagcgccggatggacttcgtcccggagaagtcagcgctcgaggtcgaagagatccgcgtcgacaaggagaccatggagatgctcgcggcactcggcatggccgatctcccgggcgtagagcgccaggctgaggtctccagcgtccccgcctacggccgcccgcagtacggaggtccccgccgtgaccgcgtctaggtttaccgccgatcgcagtggttgcgtcgtggtcgcaccgttactcacagttgttatgttactatgttaaacttgtttt

SEQ ID NO: 15644 - DNA, 524 bp, Zea mays
  Clone ID: LIB3279-226-Q6-K6-E8
cggtccgaaaccccggtcgacccagcgtccgcggtcgcgtgggcggacgcgtgggcggacgcgtgggcttctgcaggtggtccggcagcgagagaggctgtaccacctgcaggacctggtgtgcgtgcgctgcaggcaggtgaaggccgcccatctgtcggagcagtgttcctgcgggggctccttccggtgcaaggaggagccttcgtatttcctcagcaaaatgcgggtgttcctgaaggtggcggtgagccaaaagttcccgctcctgcaggactgcgtgcagtggattcttgaagccagatgacgcgggctgctacttcaacatagttcattagttcacctgatcgctaggttgtacaacgtgcacaggctgtagctccgaagagtgtataaacgggtgtatagcgctgccacagttcattgtagctctgccctgcttgcaaaaggttgttgttgtattgtagatattcaaaggtggatggcgagaaacgatagtaaccttggtatcgaaacatctggat

SEQ ID NO: 15645 - DNA, 526 bp, Zea mays
  unsure (1)..(526): unsure at all n locations; Clone ID: LIB3279-226-Q6-K6-E9
ccccgcgtccgcgaccacacaaactgacggaactgctctcagctctcctcacgcggtcacgccctgcagaacgcagggctaaacccccgtctttagcccctgctgccgcttgccactactccgcttcgttctccgccgcctccccggacgtccggaaacttctagattgaaggggatagccattggcgtcaacgtgtgtgatggaggtcaggggactggggcagctcctggcggcgctggccgcggcgttcttcgtccgcgccatcgcgggacccggccccgccctccttccgccggcggaggacacggaggccgacgaggccgacgcggaggctggcgagggaggtggtgggtggtgtgccgcccgtgaccatccggtgggctcgcatcacctgtgcattgaagaacaagcgcgggngaagtggcaagggtttcttgttgtcaaatgtgtcagggggaggccgaaaccggggaggcctgcttggcacttaatgggggccattcgggctctgggcaaaaacaactt

SEQ ID NO: 15646 - DNA, 665 bp, Zea mays
  Clone ID: LIB3279-226-Q6-K6-F10
cggtccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagttcatggaaggaaaggagaagaacattgctgtgattgttggcacagtcacagatgacaagaggatccaagaggttccagcaatgaaggttactgccctgaggttcaccgagacggcaagggccaggattgtcaatgctggtggggagtgcctcacatttgaccagcttgctctccgtgctccacttggcgagaacacagtcctcttgaggggccccaagaatgcccgtgaggcggtgaggcacttcggcaaggctcctggagtgccgcacagccacaccaagccatatgtgcgctccaagggaaggaagttcgagagggctcgtggcaggaggaacagccgtgggttcaagtttaaagaaaagtgtggccatcagcatagtaatcactttctaccgagtagtagcaca

SEQ ID NO: 15647 - DNA, 641 bp, Zea mays
  Clone ID: LIB3279-226-Q6-K6-F2
cccagcgtccgctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacaaggagggcattcccccagaccagcagcggctcatctttgctggaaagcagcttgaggacgggcgcacgctggccgactacaacat

SEQ ID NO: 15648 - DNA, 374 bp, Zea mays
  Clone ID: LIB3279-226-Q6-K6-F3
gttttatatggaaatagtttagtagagttcatttagccgtgttgtctgctggtgcctgctggtttgggtacatggctcttcgtctacaggtctacacatgtgcgagaagatttctgtgtcaaataagatgtctggttctgagatcaaaatagaacatgcgttgtccaattgttcgttcttaggggtttcactttcatccggtgtttgaaagggattctctgtaaatgcatgagctgttacggaattggcctttgtttccctcttcggcaacgtgtgaagttgatggcgatgagaacagcagtgcatcatgtaaatttgacaatgtcattcagggctaacaaacatctcgtgctaaacatcatcttggattaaca

SEQ ID NO: 15649 - DNA, 636 bp, Zea mays
  Clone ID: LIB3279-226-Q6-K6-F5
cggacgcgtgggtttttttttttttttttttttttttttttttttttttttatagaataaatcaactcggtgaatgtaaaattttatttcacatgtcaccctacttgctatgttcggggacatcaagtttccacggcgtgacacgctgaatgttggagtagctgccggtggagaaggcgtagagtaggttgagcatgacaatgaattgggtgtactcctaaagcatcttgtatgggtccaagacatgactcttctcgtcgaatgtcttgtcattgatgttttcaccctgatagatgggaaggttcacgtcgtccctcaccttgaccatggtctacgggcatttgggtgccgaacgtgagcacgtattacatctgcaggagaacgcataagttgccatagatgtcgtctctgttaatctcctttcagcattgagttttaaaagtaaaaaaatagtggatttagaaatggtgatagctagttctcttggttaataatctaaattagtgtgaagagtataaatcaattagtaggttagcgaaaacgtataaatcatagagtttgagttttttggagacgatgcaggagcaatatagttgttttgctgtaataatttgacattcattatcatgttactta

SEQ ID NO: 15650 - DNA, 506 bp, Zea mays
  Clone ID: LIB3279-226-Q6-K6-F6
ctgtcgcgtgggcgaatccgtttggtatcttcaaggagaccatcgtcagcacctcaagaatgtgcacccctgggcagagtggaacgtgctctcctgtaatgggcggtgcgccgatccatcacgatgtccagatggctgatggtgccccagatgacttcgccttcgggagcagcagcaacggcaacaacgagtcgcctggtctcgtgaaggcatgggagggggaacggatacacgaggagtgcgcctcggacgagcatgagctggagctcacccttgggagctcaaagactcgtgcagatccttcctgatcatgctgcaagagacaagtcttcacctgttttttttttactttcatctttattcggacggtgctcctctgctttatgagttcaatgtttgtagaaagagggaagggattcagagaccttatcctgctcctctggagatgatatccatcctctttcaaggatatgaactttattctagcttaagcaaattgttaactt

SEQ ID NO: 15651 - DNA, 416 bp, Zea mays
  unsure (1)..(416): unsure at all n locations; Clone ID: LIB3279-226-Q6-K6-F7
gttcagtatcggatcggagcttccataagtttccatcgggcttcgccgctcgccggtatggcgatccgcaaggggtcttcgtacgccgtcgcggcacttctcgcgctcgcctctgtcgccgccgtcgcaggggaggtcttcttccaggagaagttcgaagatggctgggaaagtcggtgggtcggggccgagtggaagaaggatgagaacatggctggtgaatggaaccacacttcgggaaaatggaatggagatgccgnggacanaggtattcaaacctccgaggattacaggttctatgccatttcagccggctaccctgngttcagcnccaaggattagaccctggtgctgctgttctctgtggtgcgcgagccgaggcttgactgcggtggtggctcctttccgttgctggg

SEQ ID NO: 15652 - DNA, 672 bp, Zea mays
  unsure (1)..(672): unsure at all n locations; Clone ID: LIB3279-226-Q6-K6-F8
caagaagaggaagagcaccaagnaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccngctgcgcgttcctcctattacacatataggcccctccctgcgtgtatgcttngtaccgtcgtgtcg

SEQ ID NO: 15653 - DNA, 646 bp, Zea mays
  Clone ID: LIB3279-226-Q6-K6-F9
cttggctggcacgatgggcggcgaggccgagggcggggagcggcggctggggcgggtgctgagctttgggatcccggacacggcgctggggctagtgatggggtacgtggaggatccctgggaccgcgacgccatctcgctggtgtgccgacactggtgccgcgtcgacgcgctcagccgcaagcacgtcacggtcgccatggcctactccacaacacccgagcgcctgttccggcgcttcccgtgcctcgagtcactcaagctcaaagcgaagccccgcgcgtccatgttcaacctcatctccgacgactggggcgggtctgcgtcgccttggatccgacagctctcggccaccttccacttcctcaagaagctccacctgcgcaggatgatagtatccaacgaagatatcaacatccttgtgcgtgccaaggcgcacatgctcgtcgcgctgaagctcgaccgctgctccggcttctccactccctccatcgcactcgtcgcccgttcctgcaggaaactggaaacacttttcctggaagaaagcacaattgatgagaaagaaatgatgagtggatccgtgagcttgctacgagcaattcttttcttgagacactgaatttctttctaacagatctcagggcat

SEQ ID NO: 15654 - DNA, 567 bp, Zea mays
  Clone ID: LIB3279-226-Q6-K6-G1
cggtcgcgtgggcaagaaggtaagtttgtaggggtccgtcggccaagctcaaaactgcctattgagatcaatggcaatgaaatactcattgaagatgctattggtagtactggactggatcttaaggtagtctatagattcattttttgcttttgaagaaatttgtgtttgtctgttaatataagtgtcttattgtttttccctttccatcagactgatccaggagttcctattgtttatgctggttttggtgcgcttatgttaacgacctgcattagctatctttcacactctcaggtatgcgtgattgtttgtcacgattcttattgacagccgaattgtaattgccttgcacctatacgaatttatggtttggtacctgctgcactagatatgggcattgcaagatggaagtacagtggtcgttggaggaaagacaaatcgagccaaacttgaattttctgaagagatgaaccggctacttgataaagtaccagagctgatcagcgccgatgagaatctattagataccaaatcgactgccacatgaaacattttttgtgtgtt

SEQ ID NO: 15655 - DNA, 596 bp, Zea mays
  Clone ID: LIB3279-226-Q6-K6-G10
caactcacaacccgagccccccaaacccgaagcagcaggagctcccctgaccttgctccgcctccgatcaaggaaaaggaagatgagctactacggccagcagccccccgtcggcgtcccgccgcagcaaggctacccggggaaggacggctacccgccagcggggtacccgccggccggctaccccccgccggcgcagggctacccgccgcagggctacccgcagcagggttacccacagcagggctacccgccgcagtacgcgcagccgcctccacagcagcagcagagcagcgggccttccttcatggaaggatgcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcttttctttttttttctctctctctctctctctgttatgagactactggtactctgtcgatgtcgattggattagactagggctggtgtgtattctgtggatgctccgtgtttctggtgggattc

SEQ ID NO: 15656 - DNA, 326 bp, Zea mays
  unsure (1)..(326): unsure at all n locations; Clone ID: LIB3279-226-Q6-K6-G11
caagaagaaagatctggccaacctgtgatgagataccggatcgagcatctcttggagactgcactgagcaagtaacacgatacgtcgataccaacctcgccttttgagaccaaagtgtgctaccaaattttgtagctccgtgcaaccatttgtttactgtaaccgtcttttgtcgcttcatcgttgtacatatctttggatttgttgatcatatcactccagagttctctgctgttggcgccgtgcgcttccattcctgcaggtgatgtaatgtgatctgataactgactccttngaaaaacaagcaagccttgatttctttnntt

SEQ ID NO: 15657 - DNA, 588 bp, Zea mays
  Clone ID: LIB3279-226-Q6-K6-G2
gcacgatcctgttgagcatggtttactatttcattctctaactaaatatttccgtaaaccgtaaacgatcctctaacatttcaccttttgccgtagggcttcatttctctaggaaagctaataatttaaaattattaaagaaaactaaactagggctttttattcgttgattgacacaattattaattaatttatgtagcagtttttagtaggaaccccttctcaaaccgaaaggtcaaaagccggagacccgcgcgattcgagcacacgattccctcgtcgggtgggtgtgggtctcgtgccgtggcctgcggtgcgggcgcttatttaatcgaaaaaattgctattttagtctttttaacgtgggttaaatgctattatgtgaccctctgtctatgacttatgggatcatatgtgtttatgatttatgggtctgagtctaaaatagagaattcacaactgagagtgacaaaatagcaaattcctccttattaatcacgagtacccgcaggcacgcacaccccacaacaacaacaaccatctccaacgcagcatgcagacagtaagaacagcaggcagcgagtgcaa

SEQ ID NO: 15658 - DNA, 445 bp, Zea mays
  Clone ID: LIB3279-226-Q6-K6-G3
aggtttccttcctcctccatgctgtcatcgccgccgccaccccggtttccttcgtaagcccgtcgtcctccgtccgcgactctgcgcgagaagcgagagtatggacacccaagtgaagcttgctgttgtggtgaaggtgatgggaaggaccggctccaggggtcaggttacccaggtcagagtgaagttcttggatgaccagaaccgtctcatcatgaggaacgtcaagggaccggttcgcgagggagacatcctcacactgctcgagtctgagagggaggctaggaggctgcgttgaggcgggatactgtcttggtagttttcgtatggagttggatgtcatctaattgtgctatgtttgtcaaactttggtatgacctttaaaacacctgccttgtatgattatttgtgagcctggtggtaagattgcagtttggtttttatg

SEQ ID NO: 15659 - DNA, 622 bp, Zea mays
  unsure (1)..(622): unsure at all n locations; Clone ID: LIB3279-226-Q6-K6-G4
cccacgcgtccgcccacgcgtccggtgngaaagaatgggttcttgcttgagctgagctcttgctgcccttgaatctgtttgggagtggagaacggagtatggggcgcggcaagatcgagatcaagaggatcgagaactctaccaaccggcaggtgaccttctccaagcgccgggccggactggtcaagaaggcacgggagatcggcgtgctctgcgacgccgaggtcggcgtcgtcatcttctccagcggcggcaagctctatgactactgctcgcccaggacctcgtctgtccattgccctctcattctttttattcttttgcttgtttattatcgtccttcttcttttcttgtgtgcaagcaaaactgatcgcaaagacccaaacttggttggaaaggcaaaactgagtaaaaaacacggttaagcgtaaaattgaggacaccaataaaaatgagggcaccagcctaaaaaacccaaatttggtttggtggcaggctgtccaggatcttggagaagtaccagaccaactccgggaagattctgtggggtgagaagcacaagaacctgagtgcagagatcgacagagtcaagaaggagaacgacaacatgcagattcagct

SEQ ID NO: 15660 - DNA, 622 bp, Zea mays
  unsure (1)..(622): unsure at all n locations; Clone ID: LIB3279-226-Q6-K6-G5
cttctctcacctnnccttcgccgttgtctaccagnnatcatcccatnnggcgtcggnagnaagaaannncagtcgaacccccgatgcgggnagnnatgaagggtccagnnaagctcgtgcctcaacattcttccgctcggcgagaaggcggnntgattcgcctctacccgcgccccgccaagggtatccggntagcagtnctgtagcggccccagtcactcggtgatttcttccaagggcaagggtacacttgtgtaggtgcgnntttgggattccgnngcgcaatgagaagaatcgcatgtctatttgtgacggtnngcggggtgggagaaggcaanntgcagctgcttggtagaagtggcttttgaagggtgaagggagtacgnnnagctgctgatggagnngagacttcagtgacacttggctttgctttnnggatttggcatttccaagagcacannttgatcttggcattcaagtattgatccatttctactggtatttctacggcattggaccttctttacgtcgtccttggagccgtgctttgggtaccccgtgtnncgcccgtcgcccgcagggtgccaagtcccccgtgttggggatccaggcacaggggtca

SEQ ID NO: 15661 - DNA, 108 bp, Zea mays
  Clone ID: LIB3279-226-Q6-K6-G6
cccagcgtccggttttgccctgggtgatgttctttgttgtcaagttttggatataacagtactcttttttaatcagtgaatgctacataatcatctcaatactttttt

SEQ ID NO: 15662 - DNA, 628 bp, Zea mays
  unsure (1)..(628): unsure at all n locations; Clone ID: LIB3279-226-Q6-K6-G7
ctttctctctcgctcaaaattgctgctggagccatctcccctctctccgacccccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccatttggagcagttgtcgtctgtaatgacgaagtagtagtcagctgccataacatggttctgaagcacactgaccctactgcgcatgctgaagtaactgcaattagagaggcttgcaaaaagcttgggaaaattgagctctcagactgcgaaatttacgcgtcctgcgagccatgcccaatgtgctttggtgcagttcatctctcccgaatcaagaggctggtttatggggccaaggcagaggctgccatcgccattggatttgatgacttcattgcagatgctctgagaggcactgggttctaccagaaggccaacttggagatcaagaaagctgacggcaatggtgcattgatcgctgagcaagtctttgaaaaactaagnagaagtccagatgtactgatgctgagcag

SEQ ID NO: 15663 - DNA, 621 bp, Zea mays
  unsure (1)..(621): unsure at all n locations; Clone ID: LIB3279-226-Q6-K6-G8
ccacgcgtccggtactctccgnnccacctcccgcttcgcggnnaccctcctcccgcttgcgnnccgacccagcgggcccttagtccgggccgccacnncgacgacgaccctgnantncgtcgtgacgccgacccgcgcgcgnccnncgctgcaggcgtacttatcctgcaccgcctcgcgcacacacctccgcctctgtcccgcagaccgctgcttctggcgtctgtcgtcgaccgcgggcgccgccacgcgcngagaccgccgcgctgctccgcggctgcggcctcatgtaccgccacctgccctcccagtcccaccgcgacgcgcccggtgctcgccggacgaggcccgagcacccggcggcgcgcggcctgcgccagaggaacgcggcgctcgaccacatcgagcaccaccgcatccacggcctcgtctacttcgccgacgaggacaacgtgtactcccttgacctcttcgaccagcttcgcggcataaggagttttggcacctggccagtcgcaatgctgggcgtggggaagagcaagacacttgtggaagggccggtttgtgacaacagccaggtagtgggatggcacacgaacgagaggaccaagaggcaacgaa

SEQ ID NO: 15664 - DNA, 659 bp, Zea mays
  unsure (1)..(659): unsure at all n locations; Clone ID: LIB3279-226-Q6-K6-G9
ctttctttctcccgttcacgccggctctacctgcgataggttcgtctctctcgtggcaacgactggccgccgccctcgcccccgcccccgcgcaggttcccaggtcttcgccggtcccttcgccgtcaaagagcacccactaggttaaatctgccagcaggacatctccatcaagtgactggtgctaattatgcgatcttcatgggctgactcagttgcgaacgccgaggaatcggcgcccgcgactgctgctgctaacggctctgttgcaactcatagcaactcgcgccctacgcgcagctcctacgtgcctcctcatctccgtggccgctcagctggtgctgctgttggagctcaagcaggctcagtagcaccagcacaaggtggaccactgccattggctgctgcacaaccttctggccagggcgctgttgttggtggccctcgctgggctggcattgtgaatggtggtnggtggtnggcagcgttggtgctcctcgccagggttatggtggtggtggtgggggggccgagcccgggttgcttggaactcccgtcctgggtggttgggaccgcagagaccgggagccagaatccgtttgccaaagccgaggctggaagaaagttgactttcgacgggcaggaagaatactggcatc

SEQ ID NO: 15665 - DNA, 653 bp, Zea mays
  Clone ID: LIB3279-226-Q6-K6-H1
ccaccacccgcgccgccgcctcctactccgccccggcccctctgatccggaccgagcgccggccatggcgctcgctttcgacgagttcgggcgccccttcatcatcctgcgggagcaggagaagaagacgcgccttagggggctcgacgcgcagaaggccaacatcgcctcggccaaggccgtcgcgcggatcctccgcacgtcgcttggacccaagggcatggataagatgctccagtcccccgacggcgacgtcatcatcacaaatgatggagcgaccatcctggagcagatggatgttgacaaccagatagcaaagctgatggtggagctgtcccgtagtcaagactatgaaatcggggatggtaccaccggggtggtagtcatggcaggggctcttctcgagcaggctgagaagcttctggagcgtggtattcaccccattagggtggctgaaggctatgagatggcgtcaaaggtagcttttgaccacttagaacatatctccgaaaagtttgagttcagtgcagacaacattgaacccctggtccagacctgcatgacaactctatcctcaaagattgttaaccgttgcaagcgggcgttggcagagattgctgtcaaagcagtacttgcggttgcagatttggaga

SEQ ID NO: 15666 - DNA, 677 bp, Zea mays
  unsure (1)..(677): unsure at all n locations; Clone ID: LIB3279-226-Q6-K6-H10
gtacgattgggtgcccgtttggtgagggatgtcgttttctgcactttgtccctggcggttacccagcagttgcaaaaatgctcaatctaggtagccctgctgtatctgcgccatcaagaactcatgtggatcacgccgctcttactggcgcctctcattcagcttcgtcaggcaagacacgcatgtgcaccaagtacaatactacagaaggctgcagatttggtgataagtgccactttgctcatagcgaaagagaacttgggaaaccagcgtacatgccttatggagaacctcctatgggcggtcgatttggaggccgacctgaacctgtgcagccagctgccatgggccctccagcaggaaactttggtgcctcggcgactgccaagatcagtgtggatgcgtctcttgccggtggcataattggtaagggcggggtcaacactaagcagataagcagagttacaggcgtcaagctctgtatccgcgaccacgagtctagccccaacctgaagaacattgagctggaaggcaattttgaccagatcaagcaagccggcgaaatggtgagggacctcatcgcgaccatcagcacgagcatgctggcgaaaaatcatctgctgccgtggctccatctggaggccganagcggtgtcctgggtggcaagaagcactac

SEQ ID NO: 15667 - DNA, 636 bp, Zea mays
  Clone ID: LIB3279-226-Q6-K6-H11
ccttatgtacccgaacttgtcctcccgggtgcacccaaagagcaggagcccgttgcaagaatccaagaggaccatgtgctccacgccaggcagcattgccgtgatgaaggagaaggaagggtcgaccggaggcacgcgttctccgctccccgacaggctggtgaattggccgtagctgtgaggccctccgacgccgccgtggaagaagccttccagggtctggggcagcttcttgcggtagagggggtcggtgatgaggttgcgccaagatttgcacacgcacgtgcaacggcggaggtctttgacgggcacgcgcgagaagatctccaccatcagctcgttgtggaggtccgccaccgccctcctctttgcgcagtccatgccgcgggagcggggaagggacgcgctgcaagctgtgagttgggaaggtgatgttcgggatggatgagcacgaaagacggggagtgcgaaatgcggcgaacgcggaactaaccggctgccggagagggtcggcgtccacgtcaatgctgcggcgctagccgacggcgcccttgctcagatgggggattctggaggaaagaaccttgagcacattcaatggcataaatgtgctggggtccctttcttttttgcgtt

SEQ ID NO: 15668 - DNA, 646 bp, Zea mays
  Clone ID: LIB3279-226-Q6-K6-H2
caccgattaacccatccatccacctcgccgccgccggagaatatggttgagcggcggtacaccgaggaggaggaggccctcgagatcaagtccctccgccgcatcatcgccgcctacgccaactatcaagacgctgcagaaagggatgtcgagagatatgagcggtcattcaaaatgcttcctacagcgcacaagaaacttcttttccacctcggtctgaagtaccaaagtctgagatggtgtatatccatgaatgcatcttttatcatgaaaatgcttgaggcgtttgaacctccttttgacatgagtcagtatatagatgctgatgttcatgctcatccatcaatcttgcatgaccatagtcatatggattgcactcattccagcgagaggggtgattgctctataattgctatctccagaagcaatttatcattggatgagcagcatgatagtcccaaagaatataccaagagacatgaaccttcaagagaaactgataataataagggagggggaagatcacatggcaggctgctcccagcctgttggcaacatggggatgtctcaaggtgcaggcattgcatgtaatggtgataaaaatacgggtgcagcagcttatttccaggataaagatgtctctgca

SEQ ID NO: 15669 - DNA, 558 bp, Zea mays
  unsure (1)..(558): unsure at all n locations; Clone ID: LIB3279-226-Q6-K6-H3
ctcaaacccacccaccaattgagcgcgcgatcaggcgccacaccggcaccggcatgcaccatgggtcctaccacagctcgcctccttcccctcctgcccttcgtcgccgtgttcctcctcgcctcccccgtggacgccgactccgccctggacgcggccacgcggtgcgcggccacgatcgtgtccatctcgccgtgcctgccgcacgtggcggccgtggcgccaccgctggctagctgcccgcctgccccaaccgacgcctgctgcgtcgccttcctccgcgctgtntccccgttggcagcgggaggcggngaggagggctgcctgtgccacctgctccgcaacccgcttctccttggctttcccatcgacgccgnccgcctcgccgcgctcctccctgcctgcgctgcgggaattgccttcgccgccgcccacgtggaggccggctccctcttcgctgacgcctgccgtgntctaaaggtgctgccgggattgcttttcatgccgcagtctacaaccgggttccgagttttccctgctgctgttcctgaattgatg

SEQ ID NO: 15670 - DNA, 626 bp, Zea mays
  Clone ID: LIB3279-226-Q6-K6-H4
aagaccgctcatttgctgaatttccagagccaaaattataagccttggaataggcgacactaccgagcccattccaaatgtcataacaaatgccatggcagagagagcacatgccttgtcaacaattgatggctacagcggttatggagctgagcaaggtgaaaagaaactcagagcagcaattgctgcaacctactatgcggaccttggtattgaagattcagacatatttgtctctgatggtgccaaatgtgacatatctcgcttgcaggtcctttttggatctaatgtgacaattgcggtccaagatccatcataccctgcatatgttgattcaagtgttatcatggggcaaactgatttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacgggtccatcatagtctatgattctgcttatgcaatgtacatatcagatgacagcccaaagtctattctttgaa

SEQ ID NO: 15671 - DNA, 624 bp, Zea mays
  unsure (1)..(624): unsure at all n locations; Clone ID: LIB3279-226-Q6-K6-H5
cccatttctgtcactggnaagcgagcaacagcaggaagctgctaatgggaagcccaatccgtctgcaccagcaccaaacggtgtccctgcagaggtgaaggcagcgaaggcttctgcagagaacggcaccgccactccagctatttcctacgcggcaaaggtggcccaagcagcaacagagaaacccgtgctcgccaacggagtcgctaagaccggttagctggaccgcccaactgatgctccatagctagccgcgagcgacggtcgacgtccccaagagctcgactgaattgctgtacaagggaactattgaccaaccaaggcaggctgtggaactgggcaggcatggcgccctagagcgttgcggctccatctcgtcgctgccggagagcagctggctagctgttagcgttttccctagtttctctctctccctctctctctgtcgctgtgttccccgtttcagtttccttatagcccgaagacttttctgctgtagtattggaatgccagagacctttggccggacaaaagggatttgcgaaggccgtctggctgtgggtgtgttgcgtcgtcattggggtcgagtatggccggttgtgttcgtcgttatattgagtggat

SEQ ID NO: 15672 - DNA, 593 bp, Zea mays
  Clone ID: LIB3279-226-Q6-K6-H6
ctagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactattccatttataatgtcaaacttatcatgcttgtcat

SEQ ID NO: 15673 - DNA, 347 bp, Zea mays
  unsure (1)..(347): unsure at all n locations; Clone ID: LIB3279-226-Q6-K6-H7
ccctntntnnttttttgttgttttttttttttttttttttgggttgttgttttttttttttttttttttttttttttttttttttttnntttttttttttttttttgggttttnnttgtttttttttggttgttttggggttgtgtttggtttttttttttnnttttnttttnnntccctnttcctctnnttttnttttgtttggtttttgggggggggggtgtttttttttttggtgtgtgttttttttgggtgtgttgtttttttttnntttttntggtgtggggtgggggtggttggtggggtttttttttcttttttttttttttttttttttccccgttttt

SEQ ID NO: 15674 - DNA, 661 bp, Zea mays
  Clone ID: LIB3279-226-Q6-K6-H8
cggtccgaaaccccggtcgacccagcgtccgctgcagcgactacagctctaattctgttggggtctcgaggaaacacagaaaagaagaaaagtgtcgcctctcatgtggttatggtggacagcctcacatccaacattaagctcatcaatagcttccaagttgctccgccctattaccggacgcaaagggcttacaggtagctttagaagctgtcataaaggcctggttgctaaattggttcctacagctcaaatcgttatcagggaccgacggcgtcggggcattcatcaacatccactgcctgatcatcgcccttgtgcctatccccaaaactattgcttgaacaaacaatgtgaactttattatctgagtaccccactcttaacttcttcactgggaatgattctagtcgatcatatcccttgctatgttggacatgtactactagcatctttaggtatatagttctatggtgtctgaatcatattatcaccatcctctctctgcttatgtcccaggaatggcttatacacttcttgggagggaaataggtctctttctcgatgctgcatcgtggttttgtctttggtcgcttgggctcatttcattagcattatatggatcgtcattggcagtaataccgatggaacactgctcctt

SEQ ID NO: 15675 - DNA, 610 bp, Zea mays
  Clone ID: LIB3279-226-Q6-N6-A10
aacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcgcctcctccgtggagaaggtgacgaagccgaagccgcgggacctctgcgtctcccgatcgaggatgatcttggactcgaggacctcgccgtaggtgctgaaggcgttgtggagggagtggtcgtccgtggcccaggcgaggccgccgacgaagcagcggtactcaaca

SEQ ID NO: 15676 - DNA, 595 bp, Zea mays
  Clone ID: LIB3279-226-Q6-N6-A11
gacaaaagtggcttccggtttatataactgactttgaatggttttacatggccaacaaagtttcatgatccgtttacctggttttctgagttcagaacccaagtgacacaatgagtaaagttcgagtggtgcattttactcagaaaataaagccaacaacaggttcaaaccagtactgaaagctaccactaaaaaatactactacacgagttacattctgaggtcgcttcatactgaaatgggtggaaagtcaaacacgagctaacgcgcatagtagacaagtttcctgctggctaacattaccaacttgcacattcatctgatgcttgaacacaggcatggaatggaacgctgcttctactctctggcctccctcccaggtgagcggctgggggacctgtcataacctggaggactagcttcccggcgctggcgatcatagtcaggactgcgccctccacccctggcatgatcgcctctgccaccaccagctgggcttactcccctgccattatcagggctgcgtcctcccctgccatagtctgggctccccctctccttgcttctcccgtaatctgggctacctctctcccgt

SEQ ID NO: 15677 - DNA, 612 bp, Zea mays
  Clone ID: LIB3279-226-Q6-N6-A2
gcacaaattcacagcgcattgaatacttcaggttcaagagggttcacataagaaatccttgacaaaccaagcaagtctgtaaaaggaagataagcagctgatacaacaagggttttgcttgatggcaactaaggtcgcccactcattcagccatcaagactggatatattgtcttgtcttgaagactggatatattgccttcacctgaacttctgccgccgtctcagctcccgctgtatagccttttttctagcctcgtccgaaaattctacattctctgcagaccgagcttgggggcttatgacactccctgaagcaccaccaggtccgtatcccggtggaaaggcttccaagtccatactccttgagccaccagttctctggattcctgcaagcattctctgctggcaggtcgaaatccacgaagtggtattgccctgactttccccgggcccgtatcctggcggaccgacttctcttgagatgcctctagtaggactcgtaaacactccctgctcacaactcgtgttccaagaaccaccattgcccctgatcttcctgtccataccctggcggaccgacttctctcgaaatggttgtaggacttgtaaa

SEQ ID NO: 15678 - DNA, 622 bp, Zea mays
  Clone ID: LIB3279-226-Q6-N6-A3
aacaatagaagctcaagtcttatagcaaaaaaaaaagttccatacaccttggtgccagtgcatcattacatacgaaaatctcactggtaatgacatctgaaccaattgatttttaatgattaaaaaaaagaaacacgtgaaaggtcatcttccagaacgtggacttcagaataatggaggggctaggggaatagtaatatatataacgcgcccaaaacgtgtgcagataaagagtatacaactcacggataaagctgctggtgatcacgcatccgtggaacgagcatggtgagaatgctggacgacagccgtggacgcgcaacgggagggcttttattcgtagctagccgtgtgtgtgagttcagaaaagatcagctttcttcttctgcaactcttgcttccaccttggctgctcgtagaactcctctttggtcatgccaaacacggtctcgaactcattgtccaccaaatatgtctctctgcgcttgtggtctatcccactgacagggtcagtagactttgataccaagcggtcgtagctaaaggtggtctggcctccgttttcgttagcagtttgttcctgtgagacacaggctctgtccggacatcttctgcaggccct

SEQ ID NO: 15679 - DNA, 536 bp, Zea mays
  Clone ID: LIB3279-226-Q6-N6-A4
caaaacctattattatcttgttaaagctggtgcttatggttttcaaaagtcacaaaaacatgatagttagcttcgctgtatcaggacaacattgcctccccaggaatccttggtgaccctcaggagcagcctagtcctgtatctgtgctagatggaccgtttaatatacgtgataacagcaggaatgtactgtactcatctccatccccacgtaaggctgagagcccatctcatcaatcttgagcagtctagagcgagacggtctcatctcaaatgcctttttgtttttacatacatgtgcagaggctttgtcgaggtctcccttgatcggatcgtttccacggtccctgtcagtgtcgtgggaggaccccccgccggaagccacgtcgtcgccgaattccctgagactctcgaggcttttctccaaggccgacgaggagctagactcgctgacgttcatccagaagctggtccgctcctgtggcatggaccgagcaagctgcgtgttggctggccctctggacccggacctgctc

SEQ ID NO: 15680 - DNA, 610 bp, Zea mays
  Clone ID: LIB3279-226-Q6-N6-A5
agtacacaacgagctctgattgctgaagatcttctcgatgaagacgaacatacaataagacacaaggacgaaactagagcaggacacatcccatccacagatctagacacgagcatgctacagcacacagtgcaaatgaagtccctactttctaagccttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccggccgcacccttcttccccttgctaccggc

SEQ ID NO: 15681 - DNA, 616 bp, Zea mays
  unsure (1)..(616): unsure at all n locations; Clone ID: LIB3279-226-Q6-N6-A6
aaacaaactccatcccattcgcttgtgcttgtatcacaaacaaccaattgttgctattgcttagatttgtcggtctaggaccaccacactataataagcagtcgctagcaaaattagatagccttgtaatagcattcttatcaatcacaagactacatacgtagctgcatgcttaattccatctcctaccctacccatcgtcatcacaaggtgagcagagccactctacgtcacgggggccggtcaaccaacaaagcaaccgccgcagcactttcctagcgttccggcacttgtcccacgccgtcctctttcccgcgctccggcgcacgcgccgcggcgacgacagctgcgacagcggcgtcatagctgtcgccagacgccgccgcgaactccgccaaggcgccggtgaccgctgccatgccagcacacagcacgcgcccagccatgccctccatcccggcagccgcgcccgagcacaccgacccgacgccggcgacgaagaagtccagaccgtccatcacccgcgcctcagtggccgngtngaccgcgcgcccccactccatgcacgccaggaacgccggcggcagcgcgtggctacttggcccgccgcggtgct

SEQ ID NO: 15682 - DNA, 608 bp, Zea mays
  unsure (1)..(608): unsure at all n locations; Clone ID: LIB3279-226-Q6-N6-A8
aacacaaattgttctctgtttttaccacgcagtcaagcacacagtcaaaagtacatgngaaacaaaacagattggacgagttattaccattctaagacacacggaagcagataatgtgtggtttacagaagcaaatggcatctggtgcaaagctactaaatgctcgactggtttctcccaccggtcagctcgacaatcctcctcactaaaattgtgaacacgagaaagaaagaaaaaagagaagctgcctgtagcctgaacataaatagctggttcctttctcgcttttgcatcgcatctgactgggctcccctgatgatacatgccaaatgcatttgtccgttgcatcggcatcagcatcattactctttgccaaaatctgcactgtaatgcgcactcgattccagcttttttgcatcatttagtttcctcacagccttcatgaagtcttcgtggactacgtaatctctctctgcacgaattgcagccatgccagcttcggtgcacacgttccgaagatcagccccattgaaaccttcagctagtttcacgactgcttcataatcaatctccccatgcttggcgataccggctgcatggatttttag

SEQ ID NO: 15683 - DNA, 446 bp, Zea mays
  Clone ID: LIB3279-226-Q6-N6-A9
aaaggaaaacctccccagccgggggccacgtaaaaaaaaaacccggaagctgggtggccttggagcaaaacccggcggggcccaaaaaaagggggggggggggaaaccccctcaaaaaccgggggttcctaaaaaggggggggaaaagggggtccccttcgggggggaaaccaaaaaaaagggggaaaccggggggacacaatttttttgggggggccaaaacataaaagtgggggggggtgaacacaagggcgtgggaacccaaaaaccccttttgggctggggccaaaaggggggggaaaaacccccttggagtttaaatttccctaagggaaaggaagggaggggtgtttcttttgggttaacaaaaaaagccccccctttaaaccccccccggggccctgataagggccctttttttattttgcggacccgggggtcccccc

SEQ ID NO: 15684 - DNA, 580 bp, Zea mays
  Clone ID: LIB3279-226-Q6-N6-B1
ttttttttttttttttttttttttttttttttttttttttttttttttttttttttttttttttttttttttttttttccagggaagcccagcacgggaaaacacgacaaaatcgggggggggctggggcccaacacttaaggaggggcggaaaaaaggtatcggggcttaaaaattggggagggcccaaaccacgactatcaaaagaaatttcaacggggggaagggcccttttaagaacaaaattggccaaacaaggggggggcttggaacttaatcgggcacgggaggacgggcaaagggttaaggactggcaaagaaggcaaaataggaccggggggggctctaaaaaggaaaaacccctcgtcttcaaaaagcagggggatggacaccggcttggggagcagggaggaccccaatggcttcccagaagttggggacattaagcacttttatgccaaactgggcggggagaaaaaaaaagcacggtctaattttccggcacggaaaggaaaaagggctggtcctttctggcagctcgagcaaaacaagggacccatcccctccaaggagtcctggg

SEQ ID NO: 15685 - DNA, 569 bp, Zea mays
  Clone ID: LIB3279-226-Q6-N6-B10
aataaaaaaaaaaatacgaattatgacatttctcccgttatacacccgctgttaactgtctgatgcacgaaagaatatgcgtcccgtgcacgggcacccgatacgagtttcctaagcagtagcattataaagagccgtgctttaatttttacacgagccatgaccagaaggaagacctttctttcagtgattgcaccctggacctggagcgcggatggccaatgcggatgtcagaaatgcccatttcccactaaaaaacatgctggaaatgcctttgctccttttggtgagtggaagaagccacgcatggcttccatcacaacgacggggtcccggcttcatcgccttcctggccaactcttcttgctcgctagtcatcgtcgtggggcctgtcacctccgttggtgttaagaggagcgacgacaccaccatctgcagcagctcgctcactgccgctgtttctttgctgcctaacaaggacctctggcacgatgaaggcagcttcttcaccaggaatttgtccctgatgagcgccttcaacttgctaaaaacagaaaactgctgccact

SEQ ID NO: 15686 - DNA, 612 bp, Zea mays
  unsure (1)..(612): unsure at all n locations; Clone ID: LIB3279-226-Q6-N6-B11
aaagatccacatgnaaaactcggcttctctaacatcctctcggctaccaatgttacaagagttcacctttgcaacccagcatagcaggtggcaaagcccataggccatagcatcaaaagccaagcacaagaactaatagctacggttgggttgtcatttacagagtgctcaaaagctaccaagaccactactctgcctgcaaaagggggtaatcacctagtccttgagtcggaaacaaaagcttgctgccatctacaattctacaaacttaagtcaaaccactggaagcctgctgtcaaacctacaattctacagtgtcaagccggccagaagcattttacttcgccatgctaatgtgcttcttaatcatgctcaaggtctccataacgccggtgtagtgttgcagtactggagaatagtgatcaagtgcagtatagatttttgcaagaagatccgttaaggcctcaacctcatcaccaagcaaatccacctcaagttcagctttctgaagattagagtctcttgtctcagatatctctttgtatcgtaaggccttctttcttaaaagatgccttcttttgcaaggtgtttaccattgttcttttaataaac

SEQ ID NO: 15687 - DNA, 613 bp, Zea mays
  Clone ID: LIB3279-226-Q6-N6-B2
ggatctgaggcatcacataaacactgtaaactctgtcttgcaaagcttctaaacatggtctggtggacagaaacatatgaaactagattcggaaaaccacaatacgagttcatcagttcttccccgtcaaactacagggcagacacagcagtagacaatctaggtcatccgctgcgcagcctccttggcgagcagcttttcccgggccttggtcttggcctgcgacttggatcccatgatgccacctccccacttcttcctgacctcatcgaacttgtcgttgaagtttgccttaatagcctccaagatcttgctgaactcaagcttatcctcgttcttgacagtggtaagacacaagactgatgcattcttcttgtgaacaatcgatccaagacgagcctttcctttaacaatgcagtaagggacctccatcttcctacacagggctggaagccacacaaccagttcaatcggatccacgtcatgagcgatgacaacaagctgagccttgttctgctcaatgaggtaagtcacatggttaaggccatacttcacaacaattggtttcttcgactcaacagtttttccttcattctcagcttgggccctcttc

SEQ ID NO: 15688 - DNA, 628 bp, Zea mays
  unsure (1)..(628): unsure at all n locations; Clone ID: LIB3279-226-Q6-N6-B3
ccaattctgtagcaccactgccatcagcctcagtttgtttcttgttcttgtcagcttcttctgcttgtttcttatcccattcttccttagctctctggttcatctgtaaaatttgacgaccaacatctgaagtaataactagtcgatgtccggtcttttcagtatcgattctctgttttgagactcgtatgagagtacttatgagtcgtcgcaatcgctcctccacacacattgataaacaatattccacatcgtcactaatatttttcagatcacatttccgagcgatttctgctagtttcctcagaagtggacccttacgtaggaaaagattttcttcttcttcctttgcaattcttcgtgcttcttgtgaggcaaggctctcttccttaggggcagacagtaactgttcttcctcttccctaatattaacaccactagcggctgtgacatcatttagttcatcgatactttgttcctgggagcctccagatgtcttctgctttttgcttgaaggttgcatagagcctgctgcttccaatgatttcttctgcccacccgatttcttgctactctntgtacctccactagcatttggtgtagagttaggagttccctgctttccttt

SEQ ID NO: 15689 - DNA, 566 bp, Zea mays
  Clone ID: LIB3279-226-Q6-N6-B4
aactcattaagattactatggcattgatccataaacagctgcctccgataccgaatgatgtgaatgccagcggtgcaaaacatgcttgaatacaaacaataccccagggctatctgctacaggcagctagctcttttcattacaatagcactacatgttggttcacaaaatatccttatagacttgaacacgtgaagaaatcacagaccagaagttcaagccggccaatctccagtctaaaaattttaaaacatgcaaaacctcatgtttttgctgtatttttcttctacagcataaaaggctgattgtttcaatcctcattctgttgaattttctcaaaactcattctgttgaattttcgtggagcaaaacatactcccggctactattgccaaacttgattgtgtccttttcaaataactcataatatcgccgaggctcaatgcgatttccattgatgaaagttccatttgtactatcaagatccatcagataaggccttattttctttgtcatcatgccatctagttgctccttctccacaagtctgtattgaagaactgcat

SEQ ID NO: 15690 - DNA, 603 bp, Zea mays
  Clone ID: LIB3279-226-Q6-N6-B5
gatgattaacatactcctgcagacactcagcatatgaggataacgcacggacacgatacaactccaacttagataagagtagctgggtgttgcacagacacaggctacttgcaaaattattagtacttcttgtcgtcgctgttggcagcgacgatggtggtggtggccacgtcaaggaacatgccggtgatcaggcgatcgctgtttcgaagaacaggctactgcttgtagattactactgctacttcttcctgtccatgactgacaccgtgccgtccttgttggcgacgatgacggtggtggccatgcccaggaacatgccgtgctctacgacgccggtgatccggagcaggcggtcactgatgtcgcgcaggtcgccgcggatgccgtcctcgaagaacatctcgacgatgtagttgccgttgtcggtgacgaagggctgctccgactccgagtccgagtcttctccccccttggcgggagcggcggggacagtcctcagcctggcgtggaatccaggcaatccgtcgaagaggccgcggatgaggcccagcgtgtggagcgcgccgaaggggatgacctcgacggggatggcgcccgtgc

SEQ ID NO: 15691 - DNA, 596 bp, Zea mays
  Clone ID: LIB3279-226-Q6-N6-B6
gtaacagcatgtaccagattaaaaacgaaattacccacgattatttaaccacttcagatccttttacaagataacccaggctaaaccataccacaacataccagtacacgtcacgtaacaataaaggtagccgcaagcagaagcagaagaacgcgtcacgtaacaatacaggtagccgtaagcaggaacagatttcttagatcttgtcgatgtcctcgtcctcgaactggatgtagtcgctgccctcctcgccttcctcgggcccatcgacgtcgacgccctcgttgagcctgagcgtgtcaggaagctccccgtaggccttgagcaggcgcgcctcgtcgttcatgtacttgaggataacgtcggccttgtcgtcctggtagtcgcggaggccgacgaggacgatgtccccagccgcgatccagaccttcttgtgcatcttaccccggatatggcagaggcggcgcgtgccatcgacgcagatggcctcgcaccgcccgttgccgagcatccgggtcacctgcgcgtactcctgcccgtcttccttgaagacgagctcgcgcttgtcgtcgtcagcctcgttctttcctcgcttc

SEQ ID NO: 15692 - DNA, 581 bp, Zea mays
  Clone ID: LIB3279-226-Q6-N6-B7
acatagaaatggtgtttagcgtcattagtcacagaaaggctggaaacgtttaggaatactggaaaccaaagttgggcagcaacatggttcttcagttcacacagacagatctgcactgcactagaggactaggcctaggggaaaagccccaacaacacctatagttccaacaaaaatccgaagcaaccagtatcagagatcccttgacaaaactaatctggccagagccaagcaggaaccgccacagattcacgaatcacgactctgagtcttctccatcttcctcggaacgctgcggcgggacgtggtggacgaagtcctccttggagaggcaggactccgggacaacggtgccgacgctcctcccgaacgcctggcggcagtaggacgacgcctcgctcccgtccacccgggtcaggttcacgttgacgagcgacaggcgcctgcacggccgggcgtcgctgcacgagaacgtgacggcgcgctccgacgccgacgtgcccgtgatgtcgatgtagttgatcttctccacctgcactgccgccgtcgcggtcgcggccagtgctactgcttcaggcgat

SEQ ID NO: 15693 - DNA, 525 bp, Zea mays
  Clone ID: LIB3279-226-Q6-N6-B8
ggctaaagtatggatgcccgggggagggggtcccgtctttttaacgaaattcgtttttttgcaccaagcactcattactcttttcgtcctcctaaaaggaaaaaacggtttttgtaaagttactgggctgtttctcctccggactggacatgaacatccacatttttaaatccttgcccctttaatactctttgatgtactgaggaatctttgcagggtctatttgctttccaacaaaacctggtccaaatctgttgctcggaacaccgggctcattttgggctgtgaaaaaacttcggaagggcgtgtaaccattggccacaacatttaattcgtctacactgaagttgtatcttttttccagggccaagtataacacctttttaacaccgaccgacattaattttttcaccgtgttgaaaaacaaattgtgaaatcatcactgtaaataacatttgcagcaaacaggactgttgcttttttagcctcctcaacttcacttgcaaaccataaataccgacttgg

SEQ ID NO: 15694 - DNA, 584 bp, Zea mays
  Clone ID: LIB3279-226-Q6-N6-B9
gcaggcaacttccaaattaaataaaacattaggtaggttcaaccgtatcatgtgcagctcgctgttttccctacacatattacaaacaagttctttcttcaacagctcaaactcagatacggggcaaagatgccagtcgcctttccagatcctcaacttcagcagaggagggttctagagcaggagccgccacgttccttgcaggacgtgcttgaccgttatcgactttcttgttagtagctccgatgcgccctttaggagccgaagagagctgaaaagccacatcgacgccaatctcgtcaaggacctggtttgggagctcttctgtttcctcctccgcctcatctttgtcaagtgtttcatcaatagcatcagacatcatctcaagcgtcatgtccaactgtgttgattgtttctggaattctttcatgacctttatctgtttcgccggttccatttgcttgttcattgctgacatagctttgcttgcacctttcattccagcagagattgaagtgccagcatacattgcctgtgtgtgagtagctactccacgaatctgtgcccgtgtgccttgcaaattg

SEQ ID NO: 15695 - DNA, 563 bp, Zea mays
  Clone ID: LIB3279-226-Q6-N6-C1
acaggaagcacaaaaactcagtagcctccttcctacagaatactacgatctcgacgacgcacggacgcatcaatactaacatgaattgaaatattacaaaaaaactggaacaaatcacgctaaactgacgcggtactttacacgaagcaaaactgcaaattctagccacacttgcgttcagaaaaaaaaactgcaagcagcaccccccgatgtggtatatcttcgttcaggtcccaatcacaggagcctcaaccatccttgggcaaatccatgagcgtgaccagctttgtgatggtttcagcaatagacacctcgttcccatctggtactggtaccagggcggcaacatctgtagatgcaccagcgctcacctggacagttgtggcgcgcccggcactgctaacttctacagcatctgccaagttcttggccaaagaactcgacgattcgctcgctttgtctgtgttcaggaacaggcagacaacggcgcagtcatcgatcttagaagtggggaaccgagtccgccaagcgcggtgagccgactcgacgagaaaccgggctgc

SEQ ID NO: 15696 - DNA, 535 bp, Zea mays
  Clone ID: LIB3279-226-Q6-N6-C10
ggggatagaaccgagggctttccattgataatagcagtgaaaatattacaccaaatgggctagaaactggaacacctcgaaacgaagatacagaacaaactacagtagaccggccaactagacacacaaccgaccacggccgtcacatcaaagcatcagaaggggaggcggcctagccgccgaagccgtagagcgtgcggccctggcgcttgagcgcgtagacgacatccatggcggtgacggtcttgcggcgggcgtgctcggtgtaggtgacggcgtcgcggatgacgttctcgaggaagatcttgagcacgccgcgggtctcctcgtagatgagcccagaaatgcgcttgacgccgcccctcctggccagcctacggatcgccggcttcgtgatgccctggatgttgtcgcgcagcaccttgcggtggcgcttggcgccgcccttgcccagccccttgccgcccttgccgcgccccgacatcgccgaaaccgagagctacgcggacggaggaggagaatcgtgccgttgtgc

SEQ ID NO: 15697 - DNA, 541 bp, Zea mays
  Clone ID: LIB3279-226-Q6-N6-C11
caaaggaaaatgccgaatagatagatcaagggggcagcaaccaatccataccatcacggggggcaaccgaaacaagacgaaggggtaccaccaccacttaagatgaagggtcaggcccaccacttgccgggaaatttaaagacaggttacaaccccatgcaggacgggaagtttgccacaaagaaatcaaccctgcccccaaagcattgcacgggggacacacatgaaaagacaacgggtgttcacgattcaaacatagcacccagcaggcaggggaggataactttggggagcccaccaacacgggcatcagttgccaccgaacaggtagcccagggaaaagccacccccaggagcagcggggaccttggttgaaggaccgcccctaaggaaattgccagtgttctgaccatcaaccctgggggagttattggtttggctgggaaccccaacagcaacctgcttggccgcatcagtctttgcaacaaatgggttctcaacagggggagcacttgcagctggtgccactgctggtttgggg

SEQ ID NO: 15698 - DNA, 256 bp, Zea mays
  Clone ID: LIB3279-226-Q6-N6-C2
caaccaaatggtacagccatttactatccatccagcaagaacgctgaaacagacaatatgttcactgaaaagaagccgcctatagccacaactacatgggaaaagggataatatatcaaggctttacatccaacacaacgcagtagttgtagcaccgcccttgttcatatgttggctttttgctatttagtaaagtaggtacagtatccaacatagactgtaaaagaatagggacgaaaattatacccttctcacc

SEQ ID NO: 15699 - DNA, 540 bp, Zea mays
  Clone ID: LIB3279-226-Q6-N6-C3
gctaaagccggaactcttatttccatactaaaaaaaaaaaaaaatgggtagtacattagcaaacagctttagagtttaaactcgtgtgcgcgcctggacgtccagaactccagacccgaaacgacagcgggggggtgagcaccgcccagcccagcaagggagagagagccgcacaccaaagcccggccgccggccgcacacgcccactggcgcttgacccgtgggagtgggaccccggcggcagcgacgggggcggcggcggcggctggaccagcacggagaccttcatgccactccagcagtagccgcggctgcagatgaagtaaaaccggcccgtgtggttgaaccggaagacgaagttgtggccgcggctgtagctgaggatggggctgctggcgtcgcacgccgggtatgccgtcttgttcacctgcaccacattgaacctgtccctttcgtacctgaattcgagccagtcgccgacgtggaactggtgacggtccccccaatctggatagttgacgttgggagcccagcgatgcc

SEQ ID NO: 15700 - DNA, 467 bp, Zea mays
  unsure (1)..(467): unsure at all n locations; Clone ID: LIB3279-226-Q6-N6-C4
atcttgaatctcgttttcactgggttacaacatgttatcagcactgctcgcgagatcagagaaaaaacttgggctgagttccttggtctaaagaacataaacttgggtcgctccagcaaccaactgggaaagagaccaagcgataaaagggcccagcatgcaacaacggattttcttggaagatattattcttgaatttttggtcatattcaagggcatcgtctccatggacaaagatgagcgaacgggttttccttggaagacttacgttttgcatatgcccgggcggttgctccctatggggctgttggtcgctagaccgcgcacgccccccgggacgtaccgcgctttggccggaggctgcgttggcccagggccccacaccaatggcctgccgcgaggcccagcccggggctagccgcactgcaaccggcagtgctacccccccccccccngggggggggggg

SEQ ID NO: 15701 - DNA, 590 bp, Zea mays
  Clone ID: LIB3279-226-Q6-N6-C5
gtcctcgcctcaaattcagtagtttattcatataatatatcactgaacattacatcctcgtctcaagttcagtagtttattcatatatcactggaacatcacagccaggcctaagcaataaagtttacacgttgaggcctaactggtcataaaatacatcagagaccggagatcgctttcagtagttcgttaagattttgtctcgtgagacaccatctgctacaagggataaggggagttcctcctgcatttcattcggtccacaaagtatggctcctgtagaagatggatttactatgttcttgtttctgaagaaagcatcctgaacatatcctcgttcacctttccagctgtcatctggttgtgataagactggtattattttaattccagttgactcccagttactaagcctttcctggtatgacatagatttcagacttgtatcaccataataaagcctcacatcagctctttctttggcagcgaaaccgaactcgataagtgatcgaatcgcactgatccccgtccccgccgcgaagatgagcacggtctgcgcgacgtcgggcggatttatcctgtcgaggggg

SEQ ID NO: 15702 - DNA, 555 bp, Zea mays
  Clone ID: LIB3279-226-Q6-N6-C6
gaaaacaataatcccagggttgaacttgaatcccaccagaaacacggagcatccacagaatacacaccagccctagtctaatccaatcgacatcgacagagtaccagtagtctcataacagagagagagagagagagaaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagcatccttccatgaaggaaggcccgctgctctgctgctgctgtggaggcggctgcgcgtactgcggcgggtagccctgctgtgggtaaccctgctgcgggtagccctgcggcgggtagccctgcgccggcggggggtagccggccggcgggtaccccgctggcgggtagccgtccttccccgggtagccttgctgcggcgggacgccgacggggggctgctggccgtagtagctcatcttccttttccttg

SEQ ID NO: 15703 - DNA, 462 bp, Zea mays
  Clone ID: LIB3279-226-Q6-N6-C7
aaatggacccacccaagggggggggggggcctagcgattaattaatccattaaacccaaaaaaaatggggcccttttaacgggcactggggaaaataaacaaaaaaacaccccccgcccggggggaaatggggaacaaaacccaaaggggaaacaaaaacaggccgccgaaaagaaaaaaacgtggaaaaccccctttttttaaaaccccgcccctttttttttctccctggggccccaaaaaaacaaggggtgggaggcacgtaagccccaggttttcctccaatgttaacgaagccaaagccgtccaaacctgggaggctaaaagttcgcccttaaggggctgggggggggttgccttttcgaatcccgggggcccctggggggggggggggggggcggcccctggggcctccttgcttttttagaaaaaaacaaaaatgtcgcccgccgccctgccctt

SEQ ID NO: 15704 - DNA, 583 bp, Zea mays
  Clone ID: LIB3279-226-Q6-N6-C8
gaaaaagaagtgaatccatacatagattcaagctaccataaatacattcatactgctctataacaaattacaagatcaactatggcaatctcgagtaagcgtcagttagtaggaaggggggtgccgttacatgtcactgcgacatagactactcagctacacaggtcacattgtcgtacaagtacgtaaccttgcatcttcaacaacaggctcgcatgcctcagatcgtcaaacatcccaggggaaatgcacagttgcaaccacaggttccagtctcaaggcgcggtcatttcacaatccaacataggagcattgcttctttgcatgttctggaatcaatttcgcgacaatgtctgatgggactcctttaagttcgtgaggcttgaaattgaatagtggtggcaaaaagcgaccatttggaaggcgagtattaggatctcgaagctcatcaaagaatgggtgaacaagtgcctccatagcagtgcatctcagatttggggagtactggagtagccgagagaccagatcaacagcttctggcggcatccttttgtggaataccttgtgccatgggtgtgctttg

SEQ ID NO: 15705 - DNA, 600 bp, Zea mays
  Clone ID: LIB3279-226-Q6-N6-C9
gcaattagcaaggaaaatgcatggatgtactagataaaccgttccagatggcagcagggacaagaacattgcggatctacactaaacatgatctagtctaactgcacggccgctaatggtaatattgttctaagacaggagatcactctacgccttcttgggggacttggcggccttcttgggctccttggccgccttctcggccaccttcttggggaggagcacagtgtggatgttggggaggacgccgccgtgggcgatggtgacgccggccagcagcttgccgagctcctcgtcgttgcggatggcgaggagcacgtggcgcgggatgatgcgcgtcttcttgttgtcccttgccgcgttgccggcgagctcgagcacctcggccgcgaggtactccaggacggcggcgaggtagacgggggcacccgtgcctacacgctgcgcgtaccggccctttttgaggtaccgcccgacgcggctgacggggaactgcagcccggccctggaggaccgcgacaccgacttcttcgtcggcccgccggccttgcgcccggccgcgcccttcttcgccttcccgcctgctccgctcacgtccat

SEQ ID NO: 15706 - DNA, 392 bp, Zea mays
  Clone ID: LIB3279-226-Q6-N6-D1
caaaccggggttgttgtaaaacaaaacccggaggctacaaaaacaaaggacgccaaaagaaaaaggagaagggaggggggagggggggggggggggacaaggacacagggggggggggggggggggggggggggggggggggggggggggaaaaaaaggggggggggggccaaggaaaaccccccccggggggggaacggcggccccccaaaaaggggggggcccttgcccgcaaatccccgggggggggggacacaaggcggggggggaaaacaacacaaatgggaaggggagggggatccaagggggggggaggggggacgcggggaggggggggggggccacggggggggccgggccgggcggggggtgggtcctctttgggggggggg

SEQ ID NO: 15707 - DNA, 467 bp, Zea mays
  Clone ID: LIB3279-226-Q6-N6-D10
agaacttaaatgctgtgccgtgaacacaaacactcgaatcacagtccatggattcataactcgtcaggtaacatgcacaactctagcaggatcaggtattcaggtggtcctaatctaaatccagttccttcctgctcttcacagtggcgttctgcttcgactctgggtccaggacattcaagtcccatgccgtggcaaggtaaccgtagaggacccatgtccgctctcccttgccatccaccttgaccagcatggggttgttatcgcccccaccgcctgtggggacggcgctccggacgcgagcccaggctgctcgcccgtggccttggcgctcgaacaactcggcgagccgtgacgcgttgttcagaccatcgaggctggcggagaacttagcttgcaccgacctctgcccgtccttcccagggagcggctgcacattgacaccggcaaagcccatttctaaaaag

SEQ ID NO: 15708 - DNA, 595 bp, Zea mays
  Clone ID: LIB3279-226-Q6-N6-D11
ggcaacacgaatcatcagtcttttaccaagatcgcttcgggacgaagcggtacacgaactaccacacaaaatagacttgtaaagccgtttttacactacttcgccacgccgtctaaaagcgaacaaacagcataaagttacaaattgcactcctccatccctccgccgccactggggccgggcgcgagatacgcctacgcgcgctcgccgcggatgcggcgggcgagctggatgtctttgggcatgatggtgacgcgcttggcgtggatggcgcagaggttggtgtcctcgaacagaccgacgaggtaggcctcggcggcttcctggagggccaggacggcgtggctctggaaccgcagatccgtcttgaagtcctgagcgatctcacggaccaggcgctggaagggcaacttccggatgagcagctccgtgctcttctggtacttgcggatctcgcgcagcgccacggtgccgggcctgtacctgtggggcttcttcacgccgccggtcgtcggcgccgacttcctcgccgccttggtggcgagctgcttgcgcggggccttgcctccggtggacttgcgggcggtctgcttcg

SEQ ID NO: 15709 - DNA, 497 bp, Zea mays
  Clone ID: LIB3279-226-Q6-N6-D2
ctctataaaaaccggacggacttttattccggaaccttttcctttttttccgaccgaattacacatgcctttttggtagaagcgggagagagagagagagagaaaagggggggagacagcagttaggggaaccccggggggggcattttggggcctgccaggaagttgctgaaaagcgtacccccctgccggggggcgtacaaaggcacctaatgcccagcgccggggatcgggacaaatgtcaggcccttgtacacaatcgtccatccaccaacctggaaaggggcgtaccacggggtccactcctggacggtcttgagcccgagcttggggagggggagcctcgtcgacgtcacggggatccttccgtcaggggcgccgttgaacacccacaacctggggccgccggcaaccagtttgcggatgacggggagggtggaaaaggcggggtctttccaagtgtaaatcgcatcgttgcagcgggtccagttgtagcc

SEQ ID NO: 15710 - DNA, 506 bp, Zea mays
  Clone ID: LIB3279-226-Q6-N6-D4
gggggggcaaacaatttaggggaaacattggtataaaaaaccccttgggataccaaaatctggttaccacaaaatggggggaacaaacaaaaagggcccattaagcccaaaagccctcttagcaaccggtaataagaggatcatatagaaggctgaacatattccaacaaggtctcaaacgagggggtttggtgggctagcaatcctaggccaaaaaacaacacactccttgccgatagggccagggaaaggggaacctttcatttcacccttgggattcaaaaacaccccaacattattttcgaaggacaaggaaacacccgccttggggggccacggtttgggctgggggacaaaaacggggggcataacctttttcctgagggggggcttcccctttttgacggggggcaagaacatgttcccaacccaagcggacgggagggggttgaggcggcccttgatgcccttgacggaaaaaagtaaagggttttgggccccgtgtt

SEQ ID NO: 15711 - DNA, 591 bp, Zea mays
  Clone ID: LIB3279-226-Q6-N6-D5
gacacaaaagcatggcacatctactctggagaacagacctattacataaccatgcccttcataaggcactttgtctattattacaataggattgcccggttcaacatgtttcaggtagctagaaactagtgcatgttcttcatgaggccaaccatcttttattataacaacagcaatattcaggcatttcggtgatgagatcaaccttcggtgcttgatgacttgacaacggtgacagggcaggttgcgttgttcacgacgtaatcgctgacacttcctaagagcaccctcttgagtttgccaaggcccctgcttcctataaccaagcagctcaacggggtgtcatggataacttgacagagcttctcacgcggatctccccacaggactttcacaaccaccataatttccttctgggtagctgtagtgttcaggaggtccaaggtttccatgtcgggttttgctccatatttcttcgcgatgatagggtcagagaattccgagagaggaatcaacggggagccggtggattcccagaggatggcctcgctctgctcgtagtcggcggacgcgtgggcggacgcgtgggtc

SEQ ID NO: 15712 - DNA, 544 bp, Zea mays
  Clone ID: LIB3279-226-Q6-N6-D6
gagcccttaaaaacctcctttttttttattaacattgcacaggctttggggatttcacgtccctgtgagaaaaacatcttaccagttttcttatatgggtatacatgcatcttatcatggtttctattctatcaaatcactcaaggggatattgattacatgtaaataagccaataaaacatggcaatgaaaccaagggtttcaataaccaagagtgaagagccaaaggggccatagagccctactgcaatgcctgtgccatggttgcccgatgaaagagttgttgctcatacagggatctgaatatctgatatttcgcatcggggtatttcttcaccttagggtctgaaaacggatttacgaccttccccgctgcattaaaagccttcattgcatcacgaacacccgggaactttttgccagcaacagcgccaaaaacagcggcacccaaaagcactgactcgctctctctaggaagtattataggacatcctgtaatatctgcatgctcttggatatacagagaattctttgcaagtccccc

SEQ ID NO: 15713 - DNA, 604 bp, Zea mays
  Clone ID: LIB3279-226-Q6-N6-D7
gtctggatgatcataacttcatcatgataaacatgccacaaccatatgcacaactgacgggacgagttttgtatttacattttgcaaattgctgatcccacatgagtgcctcttacactcaaatggccttcataacaaatctggcagacacagcagcaccctttgctgccaccttcaggacatggcggctcttgtacaaccctgctaatgtgatgccccaagtagccaagatatatataatctgtccagcctcccaaaaggttgaccatctccatcgagctttcatgctatctaatgcctttgcaacagccttttggagctgcattggcgataacgacttggattttggatcttcaagaatgcacctagcaacaaaggcggcaataccatcgactatatcgtcttcatttactatgacataattttcatcatcaatcccactaatttcctccaaattagctccagctgtatcacaagggaccaagacccacaatcctttcttcccgttacccgctttgtccggaatgtctgcagcttccacctctgtcatgtcgccagaagttagttcattaagttgacgtgctgactcatcctgtaatttctc

SEQ ID NO: 15714 - DNA, 518 bp, Zea mays
  Clone ID: LIB3279-226-Q6-N6-D8
ggccgcaatcgcgcaaattattggattttaaagtacaataagacagcaaagtttccatcgagtcacacaaaccccacatggcaatgccaacacacgccttcaagcatataacagtagtatttacgaatctaccaaacatgagtagcagtccacaggacaatgggtcattggggctcaacagcataagcctgaatcgcatctgataaagcctgaaacaacctttcagccgggggccttaagctcggcgaggcggcgagaaaggtcatcctcgtcgactttctccttatccttggcggcagggatggcgtgggcggctgcctgcggcaaaccgacggaaacctcgagcccgtagtcgtccgcgacctgctgcatgaggctgttgacctcggtctccggcgtggaaagggaggtggagccggccatggcgccctccatgaactcggcctggacctccatgttgacgaactggcgctcgaaattgtccatggtctcggacatcttctggaggttcccggtgg

SEQ ID NO: 15715 - DNA, 539 bp, Zea mays
  Clone ID: LIB3279-226-Q6-N6-D9
gaatgtaactacttcaagacattaatcagatgaagcatggtgacatcccaaatgatgatgtcaagaatgaggcagtgttattgaattctcacaagggttgggtttctcgcttgtccccccgcacacacaaaaacaaaagataagccgtggcaaaactcttgcatacctactttcaaacaactccattttaacggtccagcgaccagagctactcctccagcttccccagtatgtcgtgctctctgaaaagaaggtactctttttctgcaagcttcacttctgtcccaccgtactccggaagcagaacagtgtcgccttcgctcagagatacagggatcagcttgccatccctatcacgatcaccagggccaacagcaacgactttagcggcgttcagctggttggtggtctccgggaggaggatgccgccggcgctcttgctgggcttcagcagcttctccaccagaacccggttcagcgacgggatcagacgcttcgccatagccgcgaggaggtcttgcgcttgagatgcggtgttg

SEQ ID NO: 15716 - DNA, 595 bp, Zea mays
  Clone ID: LIB3279-226-Q6-N6-E1
gttaaagtactatatttcaaaatacaactctgtttaggacttctatttgagatgctctaacaacaaccgcaggaaaatagatgacaacatccttctatcggcggtgtgtgcgctccatcgtgaacaacagacaaccaaccttgtataacccatagacatcaacgacggcataccagacttgtggaggctaacagacgtcttgcccacctgccaagcgtcacatgcttgggtgtgtcgatgagcatgcccatcacctcgcgcgtgagggttttgagccctatcgtcccaagctccgattgggaaactactccaatcgtgatttgactaaagtcaacaacatcggccactagaatgttgcagtcatgtagcgggcgctcgacgtagccacaccaatcagatggtcatcctaaaataatacttattataatatgagatcctaatgctagcatatatatacataggttaagcctagagtccaacacaagtacagtcctatctatatgcatttaatgataacatttgactctaattataacattagttttttatcataaagctaatagagacgaagatcaccttgtagttaggtaacaca

SEQ ID NO: 15717 - DNA, 596 bp, Zea mays
  Clone ID: LIB3279-226-Q6-N6-E10
agtgacaaatcaataatgtgaaccgttcttaacaaattaaagacaacagcagcagcatgaatacaaccgattttaatttaccgcaacaaacatcacatgtctcggtagataggcggcctataataacaaagcaaacaccaaacgaaacgcgataccaactctccaatacaatgcaggcaaaggagtactagggcacaagttggcccgacagacttccgggctccggcgacggacggattttcagggcttgctgccgtgcacggggacgacggagacggagccggcggcgggggacccgggcatgccgccgaagccgctgaaggccggggagccgccgctgaagaggggcatgctgccgatgctgccgctgctgccgggcaagaacgacccgccggggaggctgctgccgctgcccggcatgctgaacgctggaatgctgctgccgcccgacgaggtgccggggaggccaccggacgccggggacgcgccgccgccgaggcggtcgaagggcgggaaggtctgcggctgcaccaccgcatcgtccttcttctccgtcgtcgtcgtcgtcgtcttgatgttcctcgcctccgcggtcg

SEQ ID NO: 15718 - DNA, 618 bp, Zea mays
  Clone ID: LIB3279-226-Q6-N6-E11
tcgctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcg

SEQ ID NO: 15719 - DNA, 329 bp, Zea mays
  Clone ID: LIB3279-226-Q6-N6-E2
gaacaaaacttttctgcgccacgaatacagcacagattttataaccatttatacagatgtagaaagtacattaattgtacaaacaccaccaaccgaaggattttatcaataataatttacaggataacttggaataggctaaacaacagataatgacagactccaaacacaagctagcctgatggagatgactggaccttgtaaatccattactggctggtcatgatctcgcgggagactaaatcgacgaattcatcattctccacaagtctcaataatgcatctctgactttggctctagtcagcgctgggcttaacccacgcgtccg

SEQ ID NO: 15720 - DNA, 613 bp, Zea mays
  Clone ID: LIB3279-226-Q6-N6-E3
atcaaatatgcttaaattccaattccaaataccaaaacaaaggtttaaatttctacaagttgatctaacagtacttcctaatacagaaaactgagcatattgaacttcagtgcatcttttagatgcagatgatctcttgagcacacatctagaattcatcttctgcaagcttctctagcaaacagcagcactggagattttctatcttccatatggatggtaacgaccagcagcaccactgccgccactgccaccatagcctgtcctagcaccatagagtccaccggtgccaaacccatcaccagtattagcccaggaagagtcataactacgaccatagctagaaccaccatagcccccagcatcacgctcatatgcaccagctaatccaccatcataactaacaccaccatacccaccaccaaggctgcctccataagtgctaccatagcgactagaataaagggaaggttcacggtatcctactaatgctccaccataagtagcatagccactaccataatcaccaggaccataagcactactgtagctgctaggcctagcgccaaaacttcgaggtgatctatagggaccaaaactaccaccataattg

SEQ ID NO: 15721 - DNA, 597 bp, Zea mays
  Clone ID: LIB3279-226-Q6-N6-E4
aggtggtaagctgttgtacagactagtataactattaaataacagatattcacttcgcagttcagactagcataactgcactccacagttcacttcttgatctacatttggctgaaatgtctgttactgatacatacgctgatattgatatggtagactagtataacaaattttcatgtttgctctgctttttcatatggtagacgggtgagacatttgataaggcaaattggacggatccatacaacaatactacattttgtgacctttgtgttgagcaaataaaggcgggtaatagggttaatggcttcatgactacccgaggttaccatgtcataactgagaagtattatctaagaaccggtttaagacattctaaaactcagttgaaaaatagatgggatctgttgaagggtctctttagctttcgggtcttggccgggcaaatggtactgttgttgctaatgaagctttctggagcgaaaacacaaaggtactcatgaagcgtgccttctgtttgtgttttttgtgacacacaaaggtactaatcattctgaattttgccaggatcactctgaatggaagaagttacaatat

SEQ ID NO: 15722 - DNA, 366 bp, Zea mays
  Clone ID: LIB3279-226-Q6-N6-E5
gggcaaaagggaaattgggggggggggggggccccccttgggggccacatggggggggggggaaccttgggggggggcccccccgccgggggtgtgtttacctttcaccccccccccccgggggggactgggggcccggggaactttgggcggggccctaaccgcggggaaaacccaagggggggggccctgggggaaaattggggccccctggggggtggggggcccatgcaaaaaaaggtcctttgcggggggggccggggccccccccaggggtaaaaaaacctacaccccccgggcccgggcgcgccgaaaagggggggggtacagagaaaacgcccgtgcgtttttcccacgcccaacggg

SEQ ID NO: 15723 - DNA, 613 bp, Zea mays
  Clone ID: LIB3279-226-Q6-N6-E6
gagacggaacaaacaaataaaaccataagcaatagcacatcagcgaagcgaagcaaagcaaagcaaccagtaaaacaaaattgggtaggcagaagaaccagcaatgtttgagaaccaaaccagccaaaatactggaacagcaatatagtctgctcacgaccaaccaaaccttcgactcataacatcctgaacaagcacttcatctctggcctggttatatgatattgctattgttttgttagagctagcctgcagcttgttcattcaaaggcccactgattctccctcctcactttagcctcttcctcaggtgtgaagtcattctcgatgtcgaatgtctcgcgtatctcctctggagtcttccccttgatcatgtccgcgacggcctggcaggtcaggtctagcagcccattgatctccaggtagtctgcagccttaatgagctccaagagggtgaccaggtcaacatcgacgaactcagcatcaaaggacttgagatcgtccgctgaggccttgttactcgcagcacttggctccgcatcaccgccatcggcgcgcggcgccgaggcgtgcttcctgcagtacgcgatgaccttgtcgaggatcttggcgt

SEQ ID NO: 15724 - DNA, 589 bp, Zea mays
  Clone ID: LIB3279-226-Q6-N6-E7
aacttataatctcttgagacttcattggcgcaagaatataactctaatgtccatcacacgcagatccaactatagaatttaaagcataacagacaagttcaaaacttaatcgccagaagaaaccacagatctaaaacaagtttaacatagtaacataacaactgtgagtaacggtgcgaccacgacgcaaccactgcgatcggcggtaaacctagacgcggtcacggcggggacctccgtactgcgggcggccgtaggcggggacgctggagacctcagcctggcgctctacgcccgggagatcggccatgccgagtgccgcgagcatctccatggtctccttgtcgacgcggatctcttcgacctcgagcgctgacttctccgggacgaagtccatccggcgctcccgctcctcctcctgcagcttgagcgagatgccacggactgggccccgctggatgcggcgcatcaggtgggtggtgaagccggcaaccttgttacggaggcgcttcgaggggaggatcgagacctcttccagcaccttcttgttggtgtggaagtcgagggtcatgcgggagtagtacttctc

SEQ ID NO: 15725 - DNA, 493 bp, Zea mays
  unsure (1)..(493): unsure at all n locations; Clone ID: LIB3279-226-Q6-N6-E8
atccagatgtttcgataccaaggttactatcgtttctcgccatccacctttgaatatctacaatacaacaacaaccttttgcaagcagggcagagctacaatgaactgtggcagcgctatacacccgtttatacactcttcggagctacagcctgtgcacgttgtacaacctagcgatcaggtgaactaatgaactatgttgaagtagcagcccgcgtcatctggcttcaagaatccactgcacgcagtcctgcaggagcgggaacttttggctcaccgccaccttcaggaacacccgcattttgctgaggaaatacgaaggctcctccttgcaccggaaggagcccccgcaggaacactgctccgacagatgggcggccttcacctgcctgcagcgcacgcacaccaggtcctgcaggtggtacagcctctctcgctgccggaccacctgcagaagcccacgcgtccgcccacgcgtccgcccacgcgtncg

SEQ ID NO: 15726 - DNA, 601 bp, Zea mays
  Clone ID: LIB3279-226-Q6-N6-E9
tttttttttttgttttttttttttttttttttttttttttttttttttttttttttttttttttttttttttttttttttttttttttttttttttttttttttttttttttttttttttttggggcccaagggggccccccttttggggccccccccccggggttttgggttcccccccccccccaagggggggggggcccccccccggggtaaaccccaaaaaaacttttttttttgccggggggcccccttgggggggggtttgggaaaatttttttttggggggggggggcccccccccaaacccccgggaaaatttgggggggcccccccccccgggggggcaaaaaaaaaaaaaaaaaaaatttggggggggggggggaaacccccccccgcccccccaaaagggggggggcccaaaaaaaaaaaaaaaaaaacgggcccccttttacccccaaaaaaataaattttttttttggagggggggaaaaaaaaaggttttcccccccggggttttttttttttttttcccaagggggggggggggggggggaccttgggggggttttttttaaaaaaagggggggggccccgccccc

SEQ ID NO: 15727 - DNA, 557 bp, Zea mays
  Clone ID: LIB3279-226-Q6-N6-F1
gagcctctcaaaaaattatatagagagattacaaagacatggcgcaagagtaagacacctgcccagactcaaatatcctaccaaccaaacatgatctaacaagagttttagttcaagacaacctcggttcaaaaaccaaatatcataaagagcagacttcacaaaaaaacagacttagaaaatcctgaatggtttccccatggggctcttgatgtagagacatcttacattctgccagttcttcttcagaagagacacgaggaagttgatgctcatctggatgttctgttggatctgcttctcctccatagacaggttaccgaccgcgacacccatgcaaaggactttcttcagttgaaacttgactgtagccttcgtctcattcaccttggattccagggattcctggtgagtgaccagagtggggaacttgcctgccttgttgagaccaggaccaaggagacggggaatttgcttgatgatggtctctgatgccaaaaaacatggtacttcttggcaagcttcttaacaagcttcttggtcttgttcattttctt

SEQ ID NO: 15728 - DNA, 454 bp, Zea mays
  Clone ID: LIB3279-226-Q6-N6-F10
ggggggaaaggggttttcaacctggaagggggaaactttggtttaaggaaccaaaagggcccaaccccccttttgggggggggcaggaggcccacccaggaaaaaaaaaaacaaagttccaataaaagggaaaaattggccccccaaaaaaaaggggggcaaaaaaacatggttttttggccaaaccagaacccaggaaacaggggacaaaaatcctaaaatttttttaaaaacccaagccagggaaaaaaaaggggctcctcccgggggggaagggattactttgcggggggcccaaaattttttaaaacctgaaacccacgggggttcctccggccaaaagcctttaaaaacttccttccctgggagccaaaaaatggctgggggggggtggccgggcctccaggagcctggccaaagggcccaaccgcctaacgggctttttgggggcccc

SEQ ID NO: 15729 - DNA, 597 bp, Zea mays
  unsure (1)..(597): unsure at all n locations; Clone ID: LIB3279-226-Q6-N6-F11
gatgagggaagctaaggactcggatcggatgtatttcacaggattccacgacactcagagcaggcccngaatgtgacacgaagaagacacacggtcctgcctcctggcaatcaaggtactactagacactaccgtgacctgtaccaacagtgacccctttggacccacacgcagacacacacaaacaggcatcgccattgaccgtcgtccctcatcgctgaaaacttgcatattataggaaggaaggacacctcagtcgacctcctccatcttgctctcctccgcggcgccctcgtcaagcgcgggcatgtcggcgtcctcgtcgccagcagcgtcctcgtcgatgttgaggccgagcttgagcatcctgtggatcctggccgcgaacgtgttggggtcgtcgaggctgaaccccgaggtgagcagcgccgtctcgaagagcagcagcacgaggtccttgacggacttgtcgttccggtcggcctcggcgcgcttccggagctcctccatgatgccgttgtccgggttgatctccatggtcttcttggaggacatgtacgcgctcatgctgctgtcacgtagcgcctgcgccttcat

SEQ ID NO: 15730 - DNA, 303 bp, Zea mays
  unsure (1)..(303): unsure at all n locations; Clone ID: LIB3279-226-Q6-N6-F12
ggctggggggttttttttttttttttttttttttttttttttttttttttttttttttttttttttttgtgggttttttttgttgtgtttttgccttgggcgcgggggggtggcnggtgttttttttttttcgtgggtttcgcttcccgtgggggggggggggggggtncttctttttgtttggggggggctggttgggttgtgggggggggcgggggttgcctttggccggtggggggccggggggcggtgttctgcgcttgttcccgccgtcgtggggggggtgcgctggggtgcgcggcg

SEQ ID NO: 15731 - DNA, 584 bp, Zea mays
  Clone ID: LIB3279-226-Q6-N6-F2
caaacaacaaacttattcatgatttgtcatagttctgggtagtacgcacacacaacacaaccggtccattattaaaccaacactgacacgactcatgacacgaacagcagatactttgacaacctccatatggagagggcaccagacgacgcaggcacatcggcagcttaaacgacccatgacttactgaccaccacggagacggagcacaaggtggagggtgctctccttttggatgttgtagtctgctaaggtgcggccatcctccagctgtttgccggcgaagatcagacgctgctggtccggggggatgccctccttgtcctggatcttcgccttcacattgtcgatggtgtccgagctctcaacctccagggttatggtttttccagtcagggtcttcacaaagatctgcataccacccctgaggcggagaacaaggtgaagggtactctccttctggatgttgtagtccgcgagggtgcgaccatcctccagctgcttgccagcaaagatcagacgctgctggtctgggggaatgccctccttgtcctggatcttggccttcaattgtcaatggtgtc

SEQ ID NO: 15732 - DNA, 438 bp, Zea mays
  Clone ID: LIB3279-226-Q6-N6-F3
ttttttttttttttttttttttttttttttttttttttttttttttttttttttttttttttttttttttttagggtaaaccaagaggggggttaacacgagaggggggggagccccggaagacaagggcaaaattacagggggcacgggggggctaaacgccaacaacttcacacgggggcgaaggggggaacaaagggcaaatccggaacaggtcaggcctttacagagaaaccctttcaaacaccgggggaaagggaaacccccaagaacgaacaatggggcaacgcaggggccattttgaccccagaaccagacaacttatttggcacaaaaaacttctcgcacaaggggagaccgggagacgaaaagccatggccccaaaccaggggggcccagcggacaacacgggtaaaagaaccccacaaaaccatttcc

SEQ ID NO: 15733 - DNA, 465 bp, Zea mays
  Clone ID: LIB3279-226-Q6-N6-F4
caggacaagtggcttgggtaaccaacaccttgaaaataacacgagctctcggccttggaacgggcctgggcaatgccacagggctagactggagcaggcgatggtcggcgaggtggcggctgccgggtacaggggggggggttaagtaacacaaaatccgtggagcttgggccgacggatcagggcggcccggatgtgtaggtgacgagcggctgatatgcgaggcgattgaagcggctttggagaccggcgctgcgatctcttacaccgcgtggcggggctcatgttggtctttgtgtgcccgaatgcggcttccagctcgaggtccacgtcgcgctcgctgctggtgcccttgggggtggggcttcgctcctcctctggaggcgctacgcggccgcccccgccggaggggggccagggaagtgcccccttccggcccgagtggggggccccccctcctcgtgg

SEQ ID NO: 15734 - DNA, 622 bp, Zea mays
  Clone ID: LIB3279-226-Q6-N6-F5
tcgcgatctagaaccttccacgtatagaattgataagtaacatgataatgaatgtcaaattattacagcaaaacaactatattgctcctgcatcgtctccaaaaaactcaaactctatgatttatacgttttcgctaacctactaattgatttatactcttcacactaatttagattattaaccaagagaactagctatcaccatttctaaatccactatttttttacttttaaaactcaatgctgaaaggagattaacagagacgacatctatggcaacttatgcgttctcctgcagatgtaatacgtgctcacgttcggcacccaaatgcccgtagaccatggtcaaggtgagggacgacgtgaaccttcccatctatcagggtgaaaacatcaatgacaagacattcgacgagaagagtcatgtcttggacccatacaagatgctttaggagtacacccaattcattgtcatgctcaacctactctacgccttctccaccggcagctactccaacattcagcgtgtcacgccgtggaaacttgatgtcaccgaacatagcaagtagggtgacatgtgaaataaaattttacattcaccgagttgatttattctataaaa

SEQ ID NO: 15735 - DNA, 506 bp, Zea mays
  Clone ID: LIB3279-226-Q6-N6-F6
aagttaacaatttgcttaagctagaataaagttcatatccttgaaagaggatggatatcatctccagaggagcaggataaggtctctgaatcccttccctctttctacaaacattgaactcataaagcagaggagcaccgtccgaataaagatgaaagtaaaaaaaaaacaggtgaagacttgtctcttgcagcatgatcaggaaggatctgcacgagtctttgagctcccaagggtgagctccagctcatgctcgtccgaggcgcactcctcgtgtatccgttccccctcccatgccttcacgagaccaggcgactcgttgttgccgttgctgctgctcccgaaggcgaagtcatctggggcaccatcagccatctggacatcgtgatggatcggcgcaccgcccattacaggagagcacgttccactctgcccaggggtgcacattcttgaggtgctgacgatggtctccttgaagataccaaacggattcgcccacgcgtccg

SEQ ID NO: 15736 - DNA, 462 bp, Zea mays
  Clone ID: LIB3279-226-Q6-N6-F7
ctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatattatgatagccctctggcttctcgccctcaggctcaggaatgtccttgctggcatcccaggccttaggcttcttagcctcctgggt

SEQ ID NO: 15737 - DNA, 559 bp, Zea mays
  Clone ID: LIB3279-226-Q6-N6-F8
accaaatagcgtttattcaaacatgttctgataaagaagcaagccatcgatgttcgatggagcctcgtagtacaaggttcgacacgacggtaacaagcatacacgcaggggggggcctatatgtgtaataggaggaacgcgcaggcggggtactaggcctgcttgcagtacacagccagatagatatgctccacctcagatattatatataataagctggccctgcatgcagggttggtttgctatggacccggcggttgctcaaaaaccatgaatcttgatgtgctccttcttcacaatgccggcctggacgaggaaattcgagacgttcttcctctgatcaccctggagctgaatgacctgtccaagttctgggtcctggaccactgtaccattgcagcagaactctttcttgagatctttgaggatcttgctgtagctgaactccttcttcaatccctggacgggggtcaggctcttgcgaccattacgctgctggatgcgcacgtgtacgtagtcctttgaccctgctgccgcaccagagtccccagcattggcc

SEQ ID NO: 15738 - DNA, 581 bp, Zea mays
  Clone ID: LIB3279-226-Q6-N6-F9
agactaattaattgacataattgttcaatacaacaatacaacagcatatgaacgaaaatcgataatatacactaaacaagggtagttattgcaaaattgtttctccaaaactacaaaagatggtaaagcttacatgcccatactggacagctaggccaagctgacataagtgctgccttcaggtattcatgattgttctcagctagcctcagttcagagctggccgtcctgcttaaagcttacctttggggttctttgcactggaacgtctgcatgtcctcatcaattggaagaacagggaccatttacttcacagatagtgggaccaatggaacttagtaccatgagattcagtctggcaaaaagcaagtatctacactcaaaatgccgggtaaagcagagttactgatggaggacaatctgtcctcctgccagcaagggagtagtatgccagaatctgtctcttatgctctgggcaaggttcatcttgatctggaacaatatactcaatgttccagaaggggcgtaccattgccataatatcagttccagttggagatgacctgaatccttgtacccac

SEQ ID NO: 15739 - DNA, 543 bp, Zea mays
  Clone ID: LIB3279-226-Q6-N6-G1
aaacaagctatcagtttagtttccccattcaaagatggacaaagggcccaattgaagggggatctaagaagttctactgaaagattggcacaccttttctattcttgcaaggccatgttttgtgaattcgaacgtgtggtctactggctcttgcgccatcccaaacaaaaacacacaaaaaatgtttcatgtggcagccgatttggtatctaatagatactcatgggcgctgatcagctctggtactttatcaagaaaccggtccatcttttcagaaaattcaagtttggctcgatttggctttcctccaacgaccactgtacttccatcttgcaatgcccatatctagtgcagcaggtaccaaaccataaattcggataggtgcaaggcaattacaattcggctgtcaataagaatcgtgacaaacaatcacgcatccctgagagtgtgaaagatagctaacgcaggtcgttaacataagcgcaccaaaaccagcctaaacaataggaactcctggatcaatctgatggaaagggaaaaaca

SEQ ID NO: 15740 - DNA, 551 bp, Zea mays
  Clone ID: LIB3279-226-Q6-N6-G10
acaataatcccaggttgaacttgaatcccaccagaaacacggagcatccacagaatacacaccagccctagtctaatccaatcgacatcgacaggagtaccagtagtctcataacagagagagagagagagagaaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagcatccttccatgaaggaaggcccgctgctctgctgctgctgtggaggcggctgcccgtactgcggcgggtagccctgctgtgggtaaccctgctgcgggtagccctgcggcgggtagccctgcgccggcggggggtagccggccggcgggtaccccgctggcgggtagccgtccttccccgggtagccttgctgcggcgggacgccgacggggggctgctggccgtagtagctcatcttccttttcctta

SEQ ID NO: 15741 - DNA, 321 bp, Zea mays
  Clone ID: LIB3279-226-Q6-N6-G11
aaagaaataaggcttgcttgtttttcaaggagtcagttatcagatcacattacatcacctgcaggaatggaagcgcacggcgccaacagcagagaactctggagtgatatgatcaacaaatccaaagatatgtacaacgatgaagcgacaaaagacggttacagtaaacaaatggttgcacggagctacaaaatttggtagcacactttggtctcaaaaggcgaggttggtatcgacgtatcgtgttacttgctcagtgcagtctccaagagatgctcgatccggtatctcatcacaggttggccagatcttgtcttcttg

SEQ ID NO: 15742 - DNA, 292 bp, Zea mays
  Clone ID: LIB3279-226-Q6-N6-G12
gctcaccctcgcggtgggcgcccgtcgtgccggtccgcttccggggtggcgcgctttctttgccgccctctctccctttggtggtggggggggggggcggttctctgctcttgctctgccctccgcaccgtcgacgtgtacgtcccggttccccttgtcgtgtttcgcgtgttcggaggcgtcctctgtgttgcccccctctctttccttctttttctctcgcccgtgcgcccgcctgtgctcccccccccgttcgtgggtgtggtccggggtgcctttgtcaccctgctgc

SEQ ID NO: 15743 - DNA, 611 bp, Zea mays
  Clone ID: LIB3279-226-Q6-N6-G2
aaccgttgggtttctatttgaacccattaaaaaacccatggatagagaaattgacccaaacccataccctaatagagaaaaatccaccgggtttcgggtagcgggtacccattgctgtctctaattcctgaattcctgattcccagcctagtagaactgggctcgagggtttcccgaacattcgctgcaatagaacaccactaggacgcatcctgattcccagcctagtagaactgaactgggctcgaggagttccccgaagatatgggaaatcatatccaattcggagttccgtctccaaactgctgattgactgctgcttacgcgagctcgtcgacgtcgaccttgatgaagatggcatcggtgaagcgggaggccagctccttgaaggccggctcgatgaagcggcagggcccgcaccaggacgccgagaagtcgatcaccatcagcttgctgctgctcttgtgggccgcccactgctcgtcgtaggtggccttggagtgcgcggccaccacggcgcagttcgggtcgtcggcggccggagggggcgtcactaaggtcgagaagaagagcccatcgctgatcgctctcgcggttgcactcgctgcctg

SEQ ID NO: 15744 - DNA, 447 bp, Zea mays
  Clone ID: LIB3279-226-Q6-N6-G3
cataaaaaccaaactgcaatcttaccaccaggctcacaaataatcatacaaggcaggtgttttaaaggtcataccaaagtttgacaaacatagcacaattagatgacatccaactccatacgaaaactaccaagacagtatcccgcctcaacgcagcctcctagcctccctctcagactcgagcagtgtgaggatgtctccctcgcgaaccggtcccttgacgttcctcatgatgagacggttctggtcatccaagaacttcactctgacctgggtaacctgacccctggagccggtccttcccatcaccttcaccacaacagcaagcttcacttgggtgtccatactctcgcttctcgcgcagagtcgcggacggaggacgacgggcttacgaaggaaaccggggtggcggcggcgatgacagcactggaggaggaaggaaaccct

SEQ ID NO: 15745 - DNA, 574 bp, Zea mays
  Clone ID: LIB3279-226-Q6-N6-G4
gggaacgacaatagctctgttaatctgtcccctcaaggtactgtacgggagtatttataggtgcccgagtgcctaccacgctcaaacaaggacgtttatgccctcgggaacccaaagttccttagaatattccccaggggaggttacagaccgtcattacagaaaagactattacagatgaagcccgtaacacgcttatccttgcggggcccgttacagtgggccgaatctcccttgggcttccggacccgatgaggacgtgaggctagcagacatcgtcggagtcttgccttcgtctcgcaatggagaagggcgaaggacgcccacgaagtccagtcgcgaagtcctcattggaccggcgtctttggcgtcgttggtgaagcgagacgacgaaggcgacgaaggcatcgagcgaatgatagcgtcttcgccttcgccccaacattatcatcaccagctaacgctgaatgatgaaacgcgagaaagagctgcaggtgaggagctccagttcagagcggcatgcagaacactatccagcaggctgtagctactcgtcttcctgcagcttcagttc

SEQ ID NO: 15746 - DNA, 551 bp, Zea mays
  Clone ID: LIB3279-226-Q6-N6-G5
ggatccaactaactccagtaggaccagtacaggcaaaaatgataatgcatccggttttcttctaatacaaatcccaccgccagatatactccattaactcgaagcactagaagagaccaagagggtctaatatcttatggggacccttaggcttaagaggggttggcttgggccttgttgaggatcacacccttgtacttgacctggaaccacttcatggggtcttccttagtgaccctgtgctggatcccaacacgggacttgcacctgcggggacgggcgacacggtacccaacacgctcaaggacgacgtaaaagtccatgccgtaaataccagtagatggatcatacttgatgccaaaaacaatgtgctcttggatgccaaatccaaagcagccagtgtcactgaagttcctcctcaacagctcgtactccttcaccttcaagccactctccagcagctgcattgccttttcaccccgcaccgtcacatagcatgcgatcttctcattgcgccggatcccaaacgaccttacagtgtaccttgcctt

SEQ ID NO: 15747 - DNA, 97 bp, Zea mays
  Clone ID: LIB3279-226-Q6-N6-G6
gagatgattatgtagcattcactgattaaaaaaaatactgttatatccaaaacttgacaacaaagaacatcatccagggcaaaaccggacgcgtggg

SEQ ID NO: 15748 - DNA, 570 bp, Zea mays
  Clone ID: LIB3279-226-Q6-N6-G7
ccatcaactgcacattttacagcaaataacaatcttgtgtctgttaacaagaaattcaggcatcatcaaaatgttgaacagtggaattgagatttttttcccgaaacatggacatttgggcactgtattatttcttgtccttatgagtaagcattgtacaaatctgagatctctcttctgctcagcatcagtacatctggaacttctctttagtcttttcaaagacttgctcagcgatcaatgcaccattgccgtcagctttcttgatctccaagttggccttctggtagaacccagtgcctctcagagcatctgcaatgaagtcatcaaatccaatggcgatggcagcctctgccttggccccataaaccagcctcttgattcgggagagatgaactgcaccaaagcacattgggcatggctcgcaggacgcgtaaatttcgcagtctgagagctcaattttcccaagctttttgcaagcctctctaattgcagttacttcagcatgcgcagtagggtcagtgtgcttcagaaccatgttatggcagctgactactacttcgtcattac

SEQ ID NO: 15749 - DNA, 599 bp, Zea mays
  Clone ID: LIB3279-226-Q6-N6-G8
atgatgtattcatgtacctaatcgggatcttttagctctttgctacaaacaaatctgcgaaaagttaagtgcatatttccttgggtgatgtacacacctaacctaaacctccgctgacccacaacagcttgacatatgccacacacgcacgtcatgctcggccgcgtctccatgtgctcgattgctgaagctgcagggcggtatgcctctgttctggctcagagaggaattaacacatccaggttttctgtcatctgccactccttcggatatacaagatgtttatcttctaggcgaagattaacattcataatttttgaacaaccagttggtatgccctccatatgagtttcatcttctacaagctgctctataaatgttgttgcctgaaacccatctctgaccgtgtccagcagccggatgtaattccacgcctgacgagccctcttgtcggcgtcccagagcatactgctattgaaagcaaagcccgaagtattgacatgaaaccttcgttgcctcttggtcctctcgttcgtgtgccatcccactacctggctgttgtcacaaaccggcccttccacaagtgtcttgctcttccc

SEQ ID NO: 15750 - DNA, 585 bp, Zea mays
  Clone ID: LIB3279-226-Q6-N6-G9
agaaaagaaaccaccaattcagataataacataagcaatccctagtacaacacaaaatgcaagattaaggcactgggaaacctcctgacaccgtactcgcaagtcaagcaacaaatttcaggcattcgctccatccaacagggactaatcgataacggttgacccatttttcacacccaacaggttgacccatttttcacttctaaccagaattcagttcagtcccaagaactcgtactctgaccaccaccatagccgctgctgccgccgccaccataagcaccaccgtatcctgacgaccccccatatccaccaccaccaccttctccttcttcgtaggaaccaccactgcccctatctcgccggaaatcacggccaccaaatctggcaccgctaccttgtctgcggtttctaccacctccacctccacctccgtaggctgagcgggcagcgtacccgtcaagccacttaggaacctcctggtttgcctctttcatgagatcactcaatggccttgcaagcgtagtgttgctctcgttgaagaagcagtcgcaagaccagatttcccagcacgtccggtccttc

SEQ ID NO: 15751 - DNA, 582 bp, Zea mays
  Clone ID: LIB3279-226-Q6-N6-H1
gacgagaagggactgactttttttataataaaaagaaactaaggactgtctagagtctatttccagatattatcgtgcacaatacaaaccaatttcggcaaaacgtcacacagggagtgagtggtaggcagcaagcctggataaggaggtacaccaatcaacacatcagcaatgccgcctacgcatatccagcatagccatccgttccttctttctgtcagtactcggacggtgagatgacatcgtcgatcttcaggatcatcttcaccacctgggtggcaagcaagatctgttgctgcttgccaatcagggtctcgaagacgttctgttctttcatgtccgtggtgccaacgtcgttgcagtctatgccacagtgggggttgctctccttgacttgttgagcttttaccgcagttaaggtatcaattggtgacaaaccactgttttcggccaatgctagtggaacagcatctaatgcatcggcgaatgacctgatagcatactgttcaactcctgggtgccgatctgcagcagtttcaacagcaattgagcaagatatctcggctgagccgccaccgtaca

SEQ ID NO: 15752 - DNA, 576 bp, Zea mays
  Clone ID: LIB3279-226-Q6-N6-H10
aagatgaatgtatgaccgtccaaacaagattggctagcagctgctaacttactgacaagtcacaacattcaggggcacaacagattaacgttttcttaaagctgaactcagttgaatccattgaaatcgcaatacgacagtctaaccgtctaacgctacaaggaggaaattcagagaagcaaatggagagcacaggacatgtcatgcctagagttggcacctcaactctcaaacagcacctctccgctgctcgttctcgccatgggcaaagtggcaccgctcgccgaagtacaagcacccttcacgaagttctcgcatagcttcgtcttgtagttgctcttgccacccagaccaccgcctcggcctccagatggagccacggcagcagatgagtttttcgccagcatgctcgtgctgatggtcgcgatgaggtccctcaccatttcgccggcttgcttgatctggtcaaaattgccttccagctcaatgttcttcaggttggggctagactcgtggtcgcggatacagagcttgacgcctgtaactctgcttatctgcttagtgttgaccccgccc

SEQ ID NO: 15753 - DNA, 556 bp, Zea mays
  unsure (1)..(556): unsure at all n locations; Clone ID: LIB3279-226-Q6-N6-H11
gttggaatactctctcatttattactcacaagttttacatgaattacgcaacaaatttcatatgcgngaaaaaggcactacgccaaaaaaaaaaaaaaacattccaatatcccaaaggtctcatagagcaaagatgattatttgctcgttccgtttttttcttagaacatttataaaacgcaaaaaagaaagggaccccagcacatttatgccattgaatgtgctcaaggcttctttcctccagaatcccccatctgagcaagggcgccgtcggctagcgccgcagcattgacgtggacgccgaccctttccggcagccggttagttccgcgttcgccgcatttcgcactccccgtctttcgtgctcatccatcccgaacatcaccttcccaactcacagcttgcagcgcgtcccttccccgctcccgcggcatggactgcgcaaagaggagggcggtggcggacctccacaacgagctgatggtggagatcttctcgcgcgtgcccgtcaaagacctccgccgttgcacgtgcgtgtgcaaatcttggcgcaacc

SEQ ID NO: 15754 - DNA, 613 bp, Zea mays
  Clone ID: LIB3279-226-Q6-N6-H2
ctgttacttctatttttaacttctgtctgcttagtttattgctcattcttacagagtccatagtacagtttgaatatctgtaatataggagaaaaggatgagctagctagcgtggctcagcacctcctttcctatgttaagccaattatattctgtgaatcaggcagctcatctgatatatctatctaacttagtctggcacggcctgtgtggagtttgaatacaacagtgaataatgatggcacaaattgatcgtccgccatggatgatcttcacttcaacgaggcttacaagcttttgaccgagatgcatctttcctcattgtccagaatgctgcacggtaccgattctgcatcattgctttcatgtttgcagtgtaagtagtctcgatcattttctccacctccattgtaaatccataatggtaagcaacctttttcacatcttccaaacttaattcaatagacatatcatcatctggcccatatgaatcagcaaagtgatacagaaggggacccaaattaatccagaccccaccatccttgagaacttttgatatgatctcgatgtattcaacgatattgtgtgcccgtatccaggaaaaagcagttac

SEQ ID NO: 15755 - DNA, 439 bp, Zea mays
  Clone ID: LIB3279-226-Q6-N6-H3
ggaagggatcagctgatcactagattccattgaagggtcaagggacacaactttgccacgtacaacactggagaccgcaaagtgctaggcatggcaaatgcagatcatttgaatcgtcaaaggctcaaagctgggcccgacaaacgcagatcaagatcgagcgaggccgacgagagtatcaaggggcacttaaacatcacaagaactatgtgataacagctcctgctgccgcgaggatcaatgctgcagtaggaataccacgggaactggggacctcagtgcctgaacgaaccattgatccagctgggggaaggggaaccgcctcctttggcttggacatcaattcagggacagcagctggggaaatttctggcccggttgttgattgcggcatgaaatgcaatcccggcagcacctttaaatcacggcaggcgtcaac

SEQ ID NO: 15756 - DNA, 556 bp, Zea mays
  Clone ID: LIB3279-226-Q6-N6-H4
aaaatgaacacagacaagacaatcacaacttcaccagtgaatgaagggtctcaggattacaacaagcattgtctagagttcgaaatggtttgaatgtagacaccgcacgagaattaaaaaaaaagttcaaaatctaacatcttctggcagcttcaccaagcgatttttggtgccctgatgtgttcttattgatacatctgtctaggagggcacagaagctgcatcggtgctcacttatacagctgctttaacctccttgcggcttcaatgatgttctctctgtgcccgaacgcgctgaccctcacaaagccttcgccacccggtccaaatccagtgccaggagtagtgaccacattggccttctccaggatctcagcgaacacatcccacgaattgcggccaggggaagtgcacccatacgtatgtgagcgttcttggcgccatacacgttgaatccgagtgatgtaaatgtctcaacgattttttcagtgttctccttgtagaagcaacaacatcttgcatagcctttaaaccgtctggagagaggcaggctaaa

SEQ ID NO: 15757 - DNA, 622 bp, Zea mays
  Clone ID: LIB3279-226-Q6-N6-H5
gctccaatctaacccacattcattcggatccactcaatataacgacgaacacaaccggccatactcgaccccaatgacgacgcaacacacccacagccagacggccttcgcaaatcccttttgtccggccaaaggtctctggcattccaatactacagcagaaaagtcttcgggctataaggaaactgaaacggggaacacagcgacagagagagagggagagagagaaactagggaaaacgctaacagctagccagctgctctccggcagcgacgagatggagccgcaacgctctagggcgccatgcctgcccagttccacagcctgccttggttggtcaatagttcccttgtacagcaattcagtcgagctcttggggacgtcgaccgtcgctcgcggctagctatggagcatcagttgggcggtccagctaaccggtcttagcgactccgttggcgagcacgggtttctctgttgctgcttgggccacctttgccgcgtaggaaatagctggagtggcggtgccgttctctgcagaagccttcgctgccttcacctctgcagggacaccgtttggtgctggtgcagacggattgggcttcccattagcagcttcctgct

SEQ ID NO: 15758 - DNA, 479 bp, Zea mays
  Clone ID: LIB3279-226-Q6-N6-H6
gaatcgaagacaagcatgataagttgacattataaatggtatagttgcaaacacgagcacttgcgagattagacacgggtttaaaaagccaacgacgggttcacacgattacaggcgaacacaccaatcagcacaaacatcaccaaatcctttattctagtcactcagggcaaatgcagcctactgctagcagggcactgaacatcaccatcccgtcgtatggattctggtaagggaacagtatcccttcattcgatcttgtcgcaatcgatgtcgggggtgatgttgtaggacaacgagaggccccaatcgccgggcagctcctgcgccgcggaaagcacaacgtggacctgaacgtaggccgccttgaggcaccggcacgtggcctgcctgtcgggcctggtgtcccccgccgcgtacagggtcctcaccccgtcgcaacactggttgttgctctcgctgggtttggctgccttgcc

SEQ ID NO: 15759 - DNA, 589 bp, Zea mays
  Clone ID: LIB3279-226-Q6-N6-H7
gaagccaaatagccctgtgggctggaccggtgacccttcctttgattaaacttgaaaatcaagaacacagtcgaagtacaaaatcgctgtggaaccctcggctcaactgttgtctacctagagagaaaactaggagctctataatgagtgctctaaataaatggcagccaagatatgctgaactaatcagccctcctatacatttatagagggttattctcacttcctaaactactactatttacatagagcctatccactccactgggggcgaaatggagcaactcctaggttttcgatccgacggccacatccttcacacggagttgcttcgccttgatgcacccttcgcgatcacaccgtgtgccaccaccggttacctccagaatataaacgttttaggacaaaaataaaaatcttagcgagtgtcaaaaaggcactcgtcaaactatctctttgacgagtgccacgataaaacactcaacaaaattacggtagctcacggtcagcaaaagcatttttaccaggtgtctatctctgccgagaggacgacactcagaatactgcctccttaccgatagccttttgc

SEQ ID NO: 15760 - DNA, 576 bp, Zea mays
  Clone ID: LIB3279-226-Q6-N6-H8
tcgcgatctatgaagctgtgcgctttatggagaggcaggggcggctgcccccgccccaactgcgggttcgcccacggcgaggctgaactccggaggccgacccctcacgcctccttccagcctcgccctcggcctgacgagaagggattacagagataaggactctagagttaggcctgatgagaagacactcaccctatgggaggctttgccctcaaagagatgtcacgcgtcgttcatttccagataagagacagacgcaagttctgaagataggggatctaggcattcaacatcacctattaggaagagcgagagaaaacatagcaaaacccctgatggaggaaaaaccgattcattcgtcagttttacaagctcagataacgaacacagacgaaaagatgaaaggtacttaagcactgatgagaaaaaggccgctgaatacaatagaaacaaatgcatctggacatggaagcattgcgtgaagatcaatcaaagctgcacgcgatattggagaagaagactgatgaagagcgcatactttgtagcagagtagaagatcttgaattgcaattg

SEQ ID NO: 15761 - DNA, 340 bp, Zea mays
  unsure (1)..(340): unsure at all n locations; Clone ID: LIB3279-226-Q6-N6-H9
tcgcgatctagaactagtcgacgagcgacgaagcgcgcagaaagagaagaacctcggagctgagatggcacaagccatggcgtcgatgaccggcctctcgcagggcgtcctgcccagcaggcgcgccgacagcagaaccaggacggccgtcgtcatcgtcagggcgtccgcggagggcgacgccgttgcgcaggcgggccgccgcgccgtgatcgggctggtggccactggcatcgtcggcggcgccttgtcgcaggcggcgcgcgccgagaccgtcaagaccatcaagattggagccccgccgccgcctcccggtggactncccnnnactntnaactct

SEQ ID NO: 15762 - DNA, 636 bp, Zea mays
  unsure (1)..(636): unsure at all n locations; Clone ID: LIB3279-227-Q6-K6-A1
cgcttgcagtttcntgaaaaggagaaggccgtgcaggtagaagttcaaggagatggcgaacgaatgcatcgacctcctggttgatgcgatgcgccgcatcccagcggagaaaagcgcccactgttctcggtgtttggtgagctgtacccggtatttgagtcagtgaggtggactgccgagggggggtgtgccaagtggtggatggcgctgcagatcatggagaagctggagatcgtgcgcaagatggtgtcgagcgcttgcggcggcacccctcttgacagaggcacggtgttcgccaggaaggtggacctcaccggtgtcgacggtcaggcgctcgccggccacggcctcgggagcaacttatcagtggtgatcttcgtgctgctccacaacgtcttcagcaacgtcaagtcggacatcgatggcatggtctctgcttccactccttattagccatcgtcacctagctacctacgtgtctacagatttgcagtcactagcctcaagtctccaagtgattggatctctgctacagtgctcttactactgccctagcgcaaatcttgatgtgtccgttctagctactactagtatctaccttggttatgttggatcatgcatgtgattgggttctgc

SEQ ID NO: 15763 - DNA, 627 bp, Zea mays
  unsure (1)..(627): unsure at all n locations; Clone ID: LIB3279-227-Q6-K6-A10
gccgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgccatatatggtcacctttaagttggtgttgcccggtgtcaggaaacggcatcacaattatcaaaagctgntattgtattctgatggcttaagatgcaccctgtgctcgt

SEQ ID NO: 15764 - DNA, 580 bp, Zea mays
  unsure (1)..(580): unsure at all n locations; Clone ID: LIB3279-227-Q6-K6-A11
ggactcgcacanatcggtgagcgagcaagcgagagaggctgggaggctaaccgcggcagggtcccgcatcctgggcggcggcggcgcacgcgccgcggcttccgccctccgacaccgcgccggcatgggcctccccgtcggccgccacatcgtccccgacaagcccctccccgtgaacgacgagttggtatgggataacggcacgcccttcccggaaccctgcatcgaccgccttgccccgcacatcggcaagtacgaggcgttggcgtggctgtgcggagggctagggttcttcgctgccctcggtatggctgctgttgtgaacgacaaggcctccaatataccatatactcccaaagtctacccgtacgacaacttgagagctgagcttggtgatagaccatagaaggttttttgtctgtttgacaaggcactttgatgaatatgatctgagatctatatctcctttccatcagagagaagcaggggngaaacttatttaccatggtttttttgtgactgccttgttgtaaaccaccgttatgtgatttgctgaatattgtgaagcatgggtttgccc

SEQ ID NO: 15765 - DNA, 619 bp, Zea mays
  unsure (1)..(619): unsure at all n locations; Clone ID: LIB3279-227-Q6-K6-A12
cttctatgacacgggagaaaccttgcaggagaacagacgtcaacagcatgctgccagcaccgatactcagaaactggtggataccaaggctcaagatcctgtggccgacatatcagatgcatttgccaaggccgtccagttgaagaatactgagaacagtgggacaacccccaaaactgagggtgcttcagctgaaaagggatccgctgccaccgccaaggttgaaggaagtgcaaacctgaacacaggccctgtggaggaaagcagttgattcgtttcccttctatctgcaaatttggagcagcagatgaatagcatggtgcgatgtgaaggtcagaaaggggaaggtgtgttgaatatggtcgtgcccccgtcagttgtacaacatcataggctttcttttatggccatttaggttataaaatttcaatatcatagttccaaaattgttgttcccgggtgtcttcgttcctgttctgttttgcttccgtcttccatgttcctgtgtcgtaccatgaatgatggttcaatttaatgggtttaggcataagaagctgcagaattatgtccgcgtnaaaagttgcattttctgcagctgaatgtgatactctgcactgtc

SEQ ID NO: 15766 - DNA, 353 bp, Zea mays
  unsure (1)..(353): unsure at all n locations; Clone ID: LIB3279-227-Q6-K6-A2
ggggggggggggggggngnnnngnnnnnggngggggggggggggggggnggnggnnnggngggggggggggggggggggnggggggggggggggggggggggggggggggggggggggggggggggnggggggggggggggggggggggggggggnggggnngggnngngnggggnnnnnnngnnngggggggggggggggggggngggnnnnnnngnnnnggngggggggnngggggggggngggggggggggggggggggggnnnnnggnnggggggggggggggggggggngnggggggggggggggggngggggggggggggggggggggggggggggggggggggggg

SEQ ID NO: 15767 - DNA, 624 bp, Zea mays
  Clone ID: LIB3279-227-Q6-K6-A3
ccccgtgtccgcccacgcgtccgcggaaggagtcggagggaaccgaaactcaggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggtttggagtgacccttctcctgtgtaacgcttgcc

SEQ ID NO: 15768 - DNA, 612 bp, Zea mays
  Clone ID: LIB3279-227-Q6-K6-A4
cggacgcgtgggcggacgcgtgggcttatcgaaacagcaagctgactcaagttctacagagctctttaggcggacaagcaaagacactgatgtttgttcaaattaatccggatactgaatcatattcagaaacaataagcactttgaagtttgctgaaagggtttctggagttgagttaggtgctgcaagaagtaacaaagaggctaaagatataaaagagctgctagaacaggtttcatatctgaaagacacaatatcacggaaagatatggaaatcgatcaactcctgaaggacaaagccaagtctccaagttcatcaacagatataaatgacagtagccaacagatccgacgactatcaggggctgctggatcaggcgaggccgaatgcaaagataacatgtctgatgatggctgctcagtggcaggaaccgagtgttctgtaggtggtgcttcagaggcgacagcagaacgaataaggccccatcaaggatagccaggctttttctcacaaagaatgggcagcctgcaaactcgaagccaaaaccaaggagtctgccctgaaaccgtcaggtcgcacgacatctacaggaagccaggcgacaggagga

SEQ ID NO: 15769 - DNA, 582 bp, Zea mays
  unsure (1)..(582): unsure at all n locations; Clone ID: LIB3279-227-Q6-K6-A5
aaaaaaaaacggggtcctccgcctcccgcaatgcctcccccttccgcctccgcctcccgcttggcgacccactggatagctgacgccctcgccgacgacgagtccctcgacttctccgtgctgaaggctctgttgggggactcgtcgaagtccctcgcgggagccccggaggccacgcgtgagcgggtcgcgctccggtgcattcaggaggtgtcgtccgtgatagcctctgggggtgatgccgcggccccggcgggggtgcctagggttgatggcgcttggtcatgcgaggatgtgttgtttcggcttatcagagacgttggaagctccggagaattggagaaggatttgcttccacctttaagtcaagacatccaggaatatatatgtaccaagaaatttacactaccagaaacttctttccagttgcttggaagttttggagaattggaggatttgcttccacctttcagtcaagacatccaggaaaatatatgtagaaagaaatttacactaccagaaacttctttccagttggcacccccngatcccctgcgtccagcacctcatccaaccatcccg

SEQ ID NO: 15770 - DNA, 606 bp, Zea mays
  unsure (1)..(606): unsure at all n locations; Clone ID: LIB3279-227-Q6-K6-A6
cgcgcctctgaaattcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacatatgcccatctgtctcatcttatgaaaggagatttgccacaaggaactacatgacccagagcctttggggcccttcaatgtctgttagcggtggcatcaatgtcccagtgatgcagaccccgctctgtgctaatgctcctgctgagaaaggaggcaagaacttcatgattgatttcatgatgggcggtgtttcagctgctgtttcaaagactgctgctgctcccatcgagcgtgtgaagctgcttattcagaaccaagatgagatgattaagtctggtaggctatcagagccgtacaagggtattgttgactgcttcaaacgtaccattaaggatgaaggtttctctttcttgtgnaggggtaacactgctaatgtnattcgttacttccctactcaggctttgaactttgcatttaaggactact

SEQ ID NO: 15771 - DNA, 600 bp, Zea mays
  unsure (1)..(600): unsure at all n locations; Clone ID: LIB3279-227-Q6-K6-A7
cttcctctctgcctctctctctcagcggcgactagggacagccgctgcctccctacgcctggtgcccaggtatcctttgccggcgacgagcacccggtaggggtatgggaatggaggtcgttggtgctgaagcagcaccagcagaggtcaaaatatccgatggagaagtgaatctattccaagagaaggaaagcaaagcaactgcaaaagaacgtgaggaggcagctgtttttggttcagagacaactgcgaatgtcactgatctggcacctccaaaggatgcgaaggatgagtggcctgaacctaagcaaacttatgtcttctacttcatcaagatccgctcatttgaggatcctaaactgagggcaaaactcgagcaggctgacaaagaattccagaagaagatccaagctcgttctaaacttattgaggcagtaagagccaagaaggcagagcgttccagtattatcgcagagttgaagcctttgagtgctgagaacaaacaatataatgaagttgtgaatgagaagataaaagagatggagcctcttcgaaacagcttgngcaagtttcgtgaggaaaacaatgccatgagggcac

SEQ ID NO: 15772 - DNA, 322 bp, Zea mays
  Clone ID: LIB3279-227-Q6-K6-A8
ggcagctccttggtggtcaattgtgcaagtctgagcaccctgaaacttccattgattcacagttcaaggctgagcctgaggatgccattgattcttatttatctgccattctctcgattgcttttggcactttggtcaatgtgcagacctctgtagctttccatcatttttttgttttagttttgcaccgtgggtgtcttgtgaattaatgtagacgcaaaacaacaactttcggcattcttctggtgtatttatgacatgtggtcaatgatatatatacatcaaactgaagtcaatagaattaatgtgttatattccattt

SEQ ID NO: 15773 - DNA, 254 bp, Zea mays
  unsure (1)..(254): unsure at all n locations; Clone ID: LIB3279-227-Q6-K6-A9
cccacgcgttccgaccacgtcgtccgtcctatctgccctactatcctctccctagcagcggagcagcttctgtcccagccgcagatactcccttttgttccctgcttctccaaaaccactctctctgcacgcttatccctgactctcccagccgctgcagccgtgctgccctccgccccggtgcccgtggggctggcctgccatttgcctcgggggctgcgttgtcatttgtcaggtaggccgnctcccccccc

SEQ ID NO: 15774 - DNA, 582 bp, Zea mays
  Clone ID: LIB3279-227-Q6-K6-B1
ggtagcccgaaccctagctagcaggtcggaggcgagagagcagccatggcgcggtgcctcgcgctcgtctccctccttctcctcggcctcgcctccgccgcctccgctgccgatgcgccctttgtcgtcgcgcacaagaaggtttcgctctcccgccccaagccgggcgtcgagcgcgtcgccgtctccctcgacctctacaaccagggatccgcgactgcctatgatgtgtcacttaatgacgactcttggccaacacaagcatttgagcttgtcactggagagaaatcgaagacattggaaaggcttgaccctggtgccactggtacacacacatatgtcctggagaccaaaacacagggcaggttccagggttcaccagctattattacgtaccgtgttcccacaaagactgctcttcaggaggcctactcaactcccatcttcccactggatattctcgctgagagacttcctgagaagaagtttgaatgggctaagaggcttgtggcgaaatatgggtcacttgtgtctgttgtctcatttgttggattgtttatctacctcgttgcgagcccgtcg

SEQ ID NO: 15775 - DNA, 577 bp, Zea mays
  unsure (1)..(577): unsure at all n locations; Clone ID: LIB3279-227-Q6-K6-B10
tacaatacctggttccagcggcatgtgngagccacaggttacgactgatgagtatgagcggggatcatatgtatactttgatttccatgtcaccgaggatggctcaggatggtgccaaagaatcaagaatgacttcacattcgagtacaacttcttggaggatgagctatcagtacaaacaaactaaagtgggctgtaggtctaatcaaaccattctgtccattgtgaattttgtagttctcatgaggtgactgacttataatctggactcttgtaaaattctccagctgtaaactaatggtgaagttggagagcattccttgtaggttctgatgcaccgaacatgctgaaattagaatcgggttgtgccagtcaaatatatttgactccgctgtatattgtcgttctcatctgctttagcagcaacaattaagtcagcttagttctaaagctacagtggagttaaaacccccaacaaaagcacaaaataagtttcagggcataactgtttttcgtttgttcatgtttaaggctaaggcacatgaataactgttttttattccttatttaaggctaa

SEQ ID NO: 15776 - DNA, 479 bp, Zea mays
  Clone ID: LIB3279-227-Q6-K6-B11
cttgatgtttatgattggtcgattccagatgacttgcttgcaaagttctctgagattaagcaggataggctacttagaggcaacttcattgttaatcctgagagcgtttacaagacccatgaggagctctgggacggtgaactctaggaaggacaccgttgtttcatcgtgagcagggagcagcgttccattagggtctgccatatcattttatctcctaatttgctctttatctgaaatgaaggttcagtgctcggaagctctgatgccatcctatatcacgaactggttcgggaatttgtcagcggtctacttgtcctacgggatgtgtgctgctgcagcaacagctgcagcctagtgtcgcttgattttctggtaactgtgaccaaagcagttagttcgccaggcattatttttgtcactatttttgtacgctccactgattctcacttgatgaacgtgctaacttgcgtgtccta

SEQ ID NO: 15777 - DNA, 142 bp, Zea mays
  unsure (1)..(142): unsure at all n locations; Clone ID: LIB3279-227-Q6-K6-B12
cggtcgcgtggngaaaaaaaaaaaaaaaaaaaaaaaaaaaaaaaaaaaaaaaaaaaaaaaaaaagggaggacagatctaaaggatccaaaactaaaaaacaacgtgcatgcaacgaaataaactcttataatgggggccccg

SEQ ID NO: 15778 - DNA, 656 bp, Zea mays
  unsure (1)..(656): unsure at all n locations; Clone ID: LIB3279-227-Q6-K6-B2
gggagaggctggattacggtacaatataattgtggggacacacctgagccttgtggtattattaagttaacaagcagttgttatggagctattttggagccttgaagggtatggagattgtttcatgcttcctcgaaactcgcccatccgtatggctgagtggaataatgtaatatttttgctggacaattcctttacttcctttgaaatagaagtgttaataggtgagcagccggagatgttaggggggtggcaaaacttggtaccaaatgtggagcttgagcagagttggaacatgtcatggcaagggccgtagcaactgcgctcccacaacatgatatgcatgcaaatatgcaatgcacaaaatgtcgatatggatgcaatccgcaagatggatgtaatcacagttcggggagaatgagcaagtaagtaaccttggtttcctttttgctgctgtaagctcgactcttttggttcatgtatcccaagaatgatgtttaatttatcttgctcactgtttcatattttttttgtgtgtgtattaaatacagtacgctagcatgaatgtaccctatatcgactntagatagtagcaggggtaaatgaaaagagctntgcatatgtctgtgtcgaccattttgacttgtagctacata

SEQ ID NO: 15779 - DNA, 322 bp, Zea mays
  Clone ID: LIB3279-227-Q6-K6-B3
aggctgcagagccaatagcaaaaccctttccaattgcagcagtggtgtttcctgcagcatctagagcatcagttctctcacgaatcctatggctcatcccagccatttcagctatgcctccagcattatcactgatagggccataggcatcaatagcaaggcctgtggcaatggtactcagcattccaagagcagccacagcaacaccatacatggcagcaaggctgaagctaaggaagatactaaacgcaatagcaaaaattgggataatgactgatttgtaacccagagcaagcccaaaaatgacattagtctagatcgc

SEQ ID NO: 15780 - DNA, 593 bp, Zea mays
  Clone ID: LIB3279-227-Q6-K6-B4
aactgatccaagtcaatggaagtggggaaacagaactgggggagctattccttagacatggagtgactccattgacaccattgaagggtctattcatacagggacctatatttatgagctttttctttgctatatcaaatatggttgagaaagtcccttctatgaaaggaggtggtgtgtattggtttactgatttgacaactcctgataatttattaatcctcccagtgttaacatcactgacctttttggctacagtagagcttaatatgcaagatggcatggaagggaatcatatgttaaaaccaatgaaaaagttctcccggttttttggagttttgtttgttccatttacaataggctttccaaaggcaattttcttttactgggtcacatcaaactttttctcacttgtttacggcgctgttctccggaatccggctgtaagactcttcttaaatcttcctcgcttggaatctcagcccacaactgcagaagtccagcccttaaacctatcgggcggaccagagccaagtcctggagtcgattctcctatcacagataaagaaactgagcagtcgagttctgtgcta

SEQ ID NO: 15781 - DNA, 197 bp, Zea mays
  Clone ID: LIB3279-227-Q6-K6-B5
aaaagagggcaaggccttccaggtatgtagtagtattcgaatgtatcatctcgttaatttagtggttattatgaggcttatataacatgtaacaactgataacacagacaagctcctacagtagttggttagatgctggtgtaagcttcttgtttatattaatctcaattgtgtttttagtttcccttgtctggatc

SEQ ID NO: 15782 - DNA, 388 bp, Zea mays
  Clone ID: LIB3279-227-Q6-K6-B6
agccgaaccccctcgcagtcgcagccccctcacgccacgcgacatgggcaagatcaggatgcccgtgccgtccctgttccgccgccgctcctccaagccgccgccgccgcagccgcagcagcaggcgcctgccgcgggcgacggcgacggcagcgggtccccggagcgggcgacggcggaggaggagatggcgcgcgtgttccgcaagttcgacgcgaacggcgacgggcggatctcgcggtcggagctggcggcgctgttcgagagcctgggccacggcgcgtcggacgacgaggtggcgcgcatgatggccgaggcggacgcggacggcgacggcttcatcagcctgcccgagttcgcggccctcaacgccacggtggccggcgac

SEQ ID NO: 15783 - DNA, 624 bp, Zea mays
  Clone ID: LIB3279-227-Q6-K6-B7
tgaggatgagcgattgaaaaaacagaagggattgaacggcatccagatgtttcaaatcactataccgacatatgtacaaacgaggctgcctctgttgcagcagaatcttcagccccatcagttgagatagtggcagagaaacagtagatgaaccatcggaggcagaaagagcagtggatgaaccggcagaatcatctttggacagttctgtctctatacctttgcctgctcctgttaatagtagtgagcctgctaactcggaagcctcttccgaacaagttgcccatgacactgatgtgcagcaaccagtcaaggaagctcctgatgaggacgttgatgcaaagaaaactgatgtagccaaagcaagcgagtgaattagcaacatgttggactgagctgatcagagcaattacttgcgaactgaaaacactgtagtgtaccctgtgctcagctgccacaagatagcctgaagcaaactgctgtacaataagcaagtgattgttctgccatcaacggtggcatatcactgtacaaatgagcaccattgactaacgcacataagtcgccttgtctgaaactggtcattttctttgaaattaccctccagttcatgtgcttttgtgc

SEQ ID NO: 15784 - DNA, 575 bp, Zea mays
  Clone ID: LIB3279-227-Q6-K6-B8
gccgccctttttttttttttttaacaaatgatatcagcgctgagttttcaccaatctccacagcctggaaagttcaagccacaacattattaacagaaaagtcgtgtcctacaccaaaccgcaagaaacgaggttacaacttatggtaagaaaatgcagtatcaggcaacaaccaagataggatgaagtccaagcttttaacttcaaaaaaagtcgctcaaaacaagtctccatatgcaggcagcgagaggcatcatctcagccagaggcagtcttcttctgctggaatatgactgcatacacagggactccaacaccgatgccaaccgctcccagcacggagagtgtcaccttcaaaccctgatgcttcatcctgtgcaagttatacatgtgcttggcatggatgtagtatggctcatcatggccatgccctcccattctcttcacgccggtggcatggaatccacgagaagctggcttggacgcctcggcgccggcggcgaggaggcggagcccggagcggagcccgcggttcagcgctgtcgccatcgcctttcgtgttctcgactgggtcg

SEQ ID NO: 15785 - DNA, 617 bp, Zea mays
  Clone ID: LIB3279-227-Q6-K6-B9
ggacgccgcctcttcgcctggcgtacctcaatgtcaccaacgtgccggtgatggtgacggagaccgggtggccgcacaagggcgacccttcctcggagcccgacgccacctccgacaacgccgacacgtacaacagcaacctcatccggcacgtgatgaacagcaccggcacgccgaagcaccccagggtggccgtgccgacctacatctacgagctgtacgacgaggacacccggcccggctccacgtcggagaagtactggggcctgttcgacatgaacggcgtcccggcctacaccctgcacctgacgggctccggcgtgctgctggccaacgacacgacgaaccagacatactgcgtggcgcgggagggcgcggaccccaagatgttgcaggcggcgctggactgggcgtgcgggcccgggaaggtggactgctccgtgctgatgcagggccagccgtgctacgacccggacaccgtggaggcgcacgccacgtacgccttcaacgcctactaccacggcatgggaatgggctccgggacgtgctacttcagcggcgtcgcggtcgtcacgacgaccgacccgaccacggatcttgtgtttatggtggggaag

SEQ ID NO: 15786 - DNA, 645 bp, Zea mays
  Clone ID: LIB3279-227-Q6-K6-C10
caaaggaagcttgctgatggacaatttgtggcagtgaagagattaacaaaaggcggtaacaaagaggacagagttagcgatttcttatctgagcttggaataatagcccatgttaaccacccaaacgcagcacagctcctggggtttagcgtggaagggggtctgcacttggttcttcagttctcacctcatggaagccttgcttctgttctacatggtacaaaggagcccctgaagtggaaagtcaggttcaaaattgcacttggaattgctgaagggctgctttatctacatgaaggctgccatcgccgcataattcacagagacatcaaggcatctaatatccttctaactgaagactaccaacctcagatatcagattttgggcttgcaaagtggctccctgacaaattgacccatcatgttgtgtatcccattgaaggcacattcgggtatatggccccagaatacttcatgcatgggatcataaatgagaagaccgatgtgttcgcatatggagttctacttcttgaactagttaccgggcggaaagcggtggactcatccagacagagcctagtgatatgggcaaaaccgctgcttgatgcgaacaacatccaagagctggtggatccttcccttgta

SEQ ID NO: 15787 - DNA, 510 bp, Zea mays
  Clone ID: LIB3279-227-Q6-K6-C11
ctacggcgggccgggccagcgcggcgcgccccaggcctgctgctggcggtggtggtgggcctcgtggtggcgggcccgctgttcctgggcggcggcggcgaggcgctgacggaggccgtggcagagctgctgagcccggtggggctgctcctcctccccgtgtgcctgctgttcctcatccgcctcctctcgtccgaccgcggcgccgcggcgctcgccgacgccttcgccttcggcgggtcccccgacgccgtccaccgcgtgggagggtccccggtcggcgtcgcgttcttgctcctcctcatcctcgcgctgctctactaccgatcctcgctcttcggcggcgacggcggcgacgacgagtaggctaggagagctggcggttgcgatctctggctgtctgttgggttggtttctgtaatgcgaggtctgcgaggggcgtgtgtgcaaaagtgcgtgtgtaaaatcgagcggaggcggttaatctgctgtttacttggtcggtttgtg

SEQ ID NO: 15788 - DNA, 597 bp, Zea mays
  Clone ID: LIB3279-227-Q6-K6-C12
gtttaaccctaccgcctatctcacgatccactcgagcaccaagccgagggaaggtgaggagcgatggcgcgcggcgtggtgtcggcgaagggcggcgcggtcgcgggcaagaagaagggtcggtttccttcacgatcgactgcaccaagccagtggaggacaagatcatggaggtcgcctcgctcgagaagtttctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctgcaaaagctatgttg

SEQ ID NO: 15789 - DNA, 568 bp, Zea mays
  Clone ID: LIB3279-227-Q6-K6-C2
tggtcctcccgtcgtcgtcgactcgtcgtcgtcggtgttgctccgatgggcaaggactcgaagccgaaggacgccaaggggaagggcaagcaggcggccggctcctctggcggcgacgacggcggcggcaagggaggcaagggcaagggcaagggcaagggcggcaagtccgctgacggactcggcacttgcacctacgtcaaagctaggcacgtattgtgtgagaagcaggggaagatcaatgaagcttataagaagttgcaggatggatggctgaataatggggacaaagttcctcctgctgagtttgctaaggtagcacaagagtattctgaatgcccatcagggaagaaaggtggagatcttggttggttcccgcgtggcaagatggctggtcctttccaggaggttgctttcaacacacctggaggaactgttagcgcaccattcaagtccacgcacgggtatcactttatcctcttgcgaagaaggaagaactgatctggaaatgtcggttgggggggactgcatcatcaggttggtttgagacgccgtgcaaaccactcac

SEQ ID NO: 15790 - DNA, 235 bp, Zea mays
  unsure (1)..(235): unsure at all n locations; Clone ID: LIB3279-227-Q6-K6-C3
gttttaagagttgctggtcggcaacagcctggagcttaaagggcctctttggtgggtcatgtcataccatatatccatatctaactttttacataaaaatagatggatggaagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgggttttaaa

SEQ ID NO: 15791 - DNA, 426 bp, Zea mays
  unsure (1)..(426): unsure at all n locations; Clone ID: LIB3279-227-Q6-K6-C4
cgtngacccgccgccgacgcagcagcaggagacgcgccaaggagagcccgcaaggaggcgactatgagggcncaagtggaagaagaagcgcatgaggaggctgaagaggaagcgccgaaagagaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagtaattgcaatgttcgtct

SEQ ID NO: 15792 - DNA, 581 bp, Zea mays
  unsure (1)..(581): unsure at all n locations; Clone ID: LIB3279-227-Q6-K6-C5
gagggctccgcgcctccgccacgccgatggcgtcccagccgccgccagagcccgcaccggccgaggcgggtctggaaagcatggagggcctcgtcctcgacacggtcatctcaagagccggcgcgcgccccgcagcggcgctcgcctgcgccagcacgcgcctccgcaccgccgttgccgacgactccctctggcgcagattctgcggtgaggacctggggctcgacgctcccgtcgatccagagggccggcctcttccctccttccaggttgcatataaactttggttggagtcttttggcatgtaccctctacctatggtaaagagagtgagacaattctggacttcaatgaaaacttggttgtctgaaaactttcctgaggcatacaaaacgttatgcgaaggtgtttctgaagctcaattaaagtcagcagaggatgatcttggtttcaagctccctatgcccacaaagctgttgtatcgcttttgcaatgctcaactgccttttagtgaggaccatgacacaaataaaagcatttccactcatggnattgattgggggctatgcgtnttatgatca

SEQ ID NO: 15793 - DNA, 523 bp, Zea mays
  unsure (1)..(523): unsure at all n locations; Clone ID: LIB3279-227-Q6-K6-C6
cngatcagtagatcgaggtcccgcccagtccagcagaagcgcacacggggatgtcccagctgagccctgctggccacatggctgcgacgctcctcctcatcctcctggcctccgcagcagcagcagcggtgtcagctgaccaacaggtctctgcctgccagaatgacatagacgcactgtggcgcagctgcaagcagttcgtccagaaggaggggcccaagatgcctccgtccgaggactgctgcaaaaccatcaaggccttagacgcgcacgcgtcctgcatctgcgactacgtcggctccccggacgccaggaataagctagacctggacaaggtgttcttcgttaccaaacagtgcggcgtcaccgtccccaaggctgcggatcaaagcaggactgaagagcggctgaatctgaatggagcaagttggctaacatacgcacggtagctacaaatacttataggaataaataaagttggtcaactgttggtttgatggtgtttggagtacaacaactgtac

SEQ ID NO: 15794 - DNA, 326 bp, Zea mays
  Clone ID: LIB3279-227-Q6-K6-C7
ccccgcgtccgcccagcgtccgcccacgcgtccgcacaggcctctcttccggtttccccccaaacccgtccgagaggcagtcatcccgccgcgatgagggccaagtggaagaagaagcggatgaggcggcttaagaggaagcgccgaaagatgaggcagaggtccaagtaggcagattcatggagtgtccccgcctggagtctctctgcgttcggttgttgtttactgagtaattttagttttttttactaagacagtctgttatggatcagaaattccttgcgtttgttcgtggtctaaatattgcatcaagtgttctgcacttt

SEQ ID NO: 15795 - DNA, 551 bp, Zea mays
  unsure (1)..(551): unsure at all n locations; Clone ID: LIB3279-227-Q6-K6-C8
gagaaactgagaaggaattgagagagaacccaaaaccttctgattctgaaattgaggcagctaaagttcttgtcaaggaaaaagtgatgtggtcgcacagcttaaagctgcaaaagccagcaaacaagagatatcaactgctgtcgatgagcttaatagggcaaaggaaattgtttcaaaactggaggagaggttcaagttaaagcctgggattccacgcaaggatgatggttcaatagcttttgaaaatgacttcttcaaacgtcaagcttttttgacagtgtctggacagcttcaggttgagacatatgcatgtgctcttagtagcgtttatacctttggaccaacattccgggcagagaactcacatacgtcacgacatttggcagagttttggatggttgaaccggaaatcgcatttgcaaacttgcaggatgacatgaactgtgcagaaaaatatgtacagtacctttgcaagtggctgcttgaccattgccagnaagatatggagtttatggtgaaaaatatgataagagtgcaattgaacgcct

SEQ ID NO: 15796 - DNA, 607 bp, Zea mays
  unsure (1)..(607): unsure at all n locations; Clone ID: LIB3279-227-Q6-K6-C9
gtctgctcgcatttcctcccaatccatcccgcctccaaacccgaactccaagtcgccccgcatcgatggcgcccaaggccgagaagaagcccgcggcgaagaagccggcggaggaggagcccgctgccgagaagcgccggccggngaagaagcccaaggcggagaagcgtgtcccagcaggcaagtccgccggcaaggagggcggcgagggaaagaggggccggaagaagggcaagaagagcgtggagacctacaagatctacatcttcaaggtgctgaagcaggtgcacccggacatcggcatctcctctaaggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtcctaggctgcgtggcctccgcttgcaggcttccctcgtatgttcgcgtgtcttgctgtagttaggtgctgctgtgtctggtctcctccggtagc

SEQ ID NO: 15797 - DNA, 638 bp, Zea mays
  Clone ID: LIB3279-227-Q6-K6-D10
gagcgcgcgggcgaggaggacccccgacggaggatggcggcggcggctagggttttccgcgggtccctcttcctgatgtccccggcggcgggcgccaaggcgtcggcagccaagaaggcgggcgcggcggcggcggcggcggcggtggccaagaagaccgaggcggccactacgaagccgagactgccgaccgggatcacgaagccgatgccggtctccgatgagttccgcaggttcgccggcggcgcgcccgaggtcgcacgctccgaggccatcaagctcatctgggcccacatcaaggcccacggcctccagaacccagccaagaaaacggagatcaactgcgacgccacgctcaaaagcttgtttggcgggagggacaaggttgggatgctggagatcaacaggctactgaacgctcacttcccgaagaactagcaagcagcagtccgtggggccagtgatcgcgctttggtaaaggactttcttgtggctggcctcttgtggtccatgtgaagtcccaagtcccactaggtggttacgcccgaaaaccgtgtgatgccattaagacttacagactttgttcagcagttgggtttttgggcgtgatgcatgtaaaaaggaccccagtgtttctg

SEQ ID NO: 15798 - DNA, 659 bp, Zea mays
  Clone ID: LIB3279-227-Q6-K6-D11
gttctgactagccacatccagtcaagcagtaaaggcgcaccatggaggcggcggcggagaataaggaggccgagcaggaggagcagcagctaccgcacgcgcagaaggataacgcgcccgccgccgccgaggaagacgaagcggattcggaggagaccgagcgccgcaaccgcgacctcaagtccggccttcacccccttaggcacaaactcgtgctctggtacactcgccggacgcctggagcgaggtcgcagtcgtacgaggacaacatcaagaagatcatcgatttcagcacagtcgaatcgttctgggtttgctactgccaccttgcgcgcccttcttccctgccgagccccactgaccttcatctcttcaaggatggcatccgtcccctctgggaggatcctgcaaaccagaatggtggcaagtggataattagattcaaaaaggcagtttcaggtcgattttgggaggatttggtgctagtggtagtaggcgaccagcttgagtatagcgatgatgtctgtggtgttgtgcttagtgtccgtttcaatgaagacattctgagcgtctggaaccggaacgcatcagaccatcaggctgtgatggcattgagggattctatcaagaggcacctcaagctgccgcacagctatctg

SEQ ID NO: 15799 - DNA, 551 bp, Zea mays
  unsure (1)..(551): unsure at all n locations; Clone ID: LIB3279-227-Q6-K6-D12
gctttaaggcgccgagnacgccatggcgtcctactgctccgagctgcagttcctggggaacccggtcaccaaccacgtgcagagcgcggaacagcacaaccaggacgtcaactcgctgggactcatctcctctaggaagactgctgaggccatcgagatcctgaagctcatgtcctcgacgttcctgatcgccctgtgccaggccgtggacctgcgccacatcgaggagaacgtcaagagcgctgtcaagagctgcgtgatgacggtggcgaagaagaccctgagcaccaactccaccggtggtctccacgtcgcccgcttctgcgagaaggacctgctccaggagattgagcgcgaggcggtgttcgcgtatgccgacgacccctgcagcgctaactacccactgatgaagaagcttcgcaacgtgctcgtggagcgcgccctcgccaacggcgctgccgagttcaacgcggagacatccgtgttcgccaaggtcgcccagttcgaggacgacctgcgtgcggcgctggccaaggcggtgggagctgcac

SEQ ID NO: 15800 - DNA, 443 bp, Zea mays
  unsure (1)..(443): unsure at all n locations; Clone ID: LIB3279-227-Q6-K6-D2
cccacgcgtccggtagaacagtgttaaaattttgggactagaaatacaccaaatcagcaagggtgggacatgaggcattcttctacgcggaaacagtaggatagttccgtagtagttgtggcccaggtatgatgctacctagaaatggtggaatgaccattgctgctaggaggcggctgtaaatatgaacaattatagaggatgatttattcagattctttttttagggggtgtttgaatgcactatagctaatagttagttggctaaaaatttgctagtgaaattagctagctaactattaactaatttgctaaaaatagatatcttcaactaattttagcaattaactattagttttaatgcattcaaattcaaatacccctaaagaatatgcatggtggttgnaaaaaaaaaaaaaaaaaaaaagaggagaagnaagnag

SEQ ID NO: 15801 - DNA, 609 bp, Zea mays
  unsure (1)..(609): unsure at all n locations; Clone ID: LIB3279-227-Q6-K6-D3
ccgtatccccaattcctccttcggnatctcgcattcagcgcagcgcaggtgtngaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacacttcctgcgccagcgacactggtacatccagagcacttgtgcccacaactggcgagggtcttgttgagggcctggactggctgtccagcacattg

SEQ ID NO: 15802 - DNA, 629 bp, Zea mays
  unsure (1)..(629): unsure at all n locations; Clone ID: LIB3279-227-Q6-K6-D4
gcggcttcgatctttcctctcctatcacctgaatccctcgagtattcatcgccggcgcagcgcggtctcttcccttcgctggagaagggggaaggggacacgaacggagcagaaggccatggacacgatgcggggcgcgctggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagtttgatatgatgcttgattctgtgcgaatatatgccactgctatatatattgcaagcatcataattgctctattctgtgctatctacgttcgcagcaagctgctgactctagtggccatcattttggaatntggtgcccttatttggtacagccttagctacatacctttcgcaaggtcgattgtgtcgaaagtgatgacatcgtgcttcg

SEQ ID NO: 15803 - DNA, 508 bp, Zea mays
  unsure (1)..(508): unsure at all n locations; Clone ID: LIB3279-227-Q6-K6-D5
ggccagcattggtgagctgctgtgggggttcttccactactgggcgtcccagcaccgctacaagcgcgacgtcatctccgtccgcctggggaagacgatcagaaagcaggagaagggctggacgacgcgcgtcgggggcgaccgccacctgatgtgcatcgaggatccgttcgagaccggccatgacctcggccgcgtcgtcgacaggcagaccatctggatcatcagggaggagatggagcgagccgccaccgtgctgcagaacgacgacgacccctgcgcgactctcttcgagccctatggttatgacttatgagaactgactgactgattgatcgatcgatcgatcggggctctagtgctggctgctgcagaaacgaggctctagtgtttgttgatagctcagatgacagttctctggacattgtgacgatattaataaaattccggagacagcagannaaaaaaaaaaaaaaaaaaaaaaaaaaaaaaaaaaaaaanaggggcg

SEQ ID NO: 15804 - DNA, 561 bp, Zea mays
  Clone ID: LIB3279-227-Q6-K6-D6
cccacgcgtccgcccacgcgtccggtcatctcagagtattgtaggaaatgttctggagaggggcgtatccgtgtcaggaaggagatcaaagtaaaaatccctccaggagtgagcaaaggcagtactcttcgtgtacgtggggaaggtgatgcaggatcaaaagtgggcctcctggagatctctttgtttgcctcgatatagaggagccatcagatatcaagagggatggtataaacttgtattcaactgtgtcaataagctatcttgaagctattttgggcaccattaagaaggtcagaacagttgatggaaccaatgaccttcgaatacctccaggtacccaacctggtgatgtaattgccttagcgaagcaaggggttccatcattgaataagccgactatacgtggtgatcatctgttcactgttaaagttgcaatacccaagcgcataagtgggcgcgaaagggaattactggaggaacttgcatctttgagtaatggtggctttgttcgaacagatgccaagccaaaacctgcccagccaaaacgtgtacatctag

SEQ ID NO: 15805 - DNA, 500 bp, Zea mays
  Clone ID: LIB3279-227-Q6-K6-D7
gcgggcaatatcaagttttctggaaaataaattgaaatgtccctgaaataaggatgggtcagacgacgacgacgatgacgacgacgatgaagacaatgacgatgagggtggtgacgacgatgatgatgctgaggaggaattctctggagaagaagatgggggtgatgacgatgatgaagatgatgatcctgaagctaatggtgaaggaggaagtgacaacgacaatgatgacgacgaagatggtgatgatgatggcgatgaggacgacgaaggtgatgaggacgacgaagacgaggacgatgatgaagatgacgaagaccagccaccttccaagaagaagaaatgatttgctcatccatggatttacctcagcttctccatgctgttagttgtgttgtttagatcatggacagctttgggatcaatgtagcttgttgcttgtcatggtatcgtagtgtaggaaaatttgacatctgatgttaaatcactatcctgctttc

SEQ ID NO: 15806 - DNA, 596 bp, Zea mays
  Clone ID: LIB3279-227-Q6-K6-D8
cggacgcgtggggttctagatcgcgagcggccgcccgcgatctagaggatggggaactattgaaccaccaaagtaccagtgagtcagaggagtgctttatggcatttgcgagggtcttcagtggcgtccttcatgcagggcagaaggtatttgtgctatcaccattgtatgatccagtgaaaggggatacggttcagaagcatgtgcaggaggtggagctgcaatacttgtatgagatgctaggacaaggcctgaagccagttgccagcgtgggtgcagggaatgtggttgcaatccagggtcttgggcagcatatattgaagagcgccacattgtcgtccaccaagaattgctggcccttctcgagcatgatgttccaggcgtctccgatgcttaaggttgcaattgagccctcaaatccagctgatttaggagctcttgttaaagggcttaggcttcttaaccgggcagacccatttgttgagtatacagtttcgcagaggggcgagcatgtccttgctgctgctggtgagatacatttggagcggtgcataaaggatttggaggagagattctcaaagtcaaattggtggtct

SEQ ID NO: 15807 - DNA, 566 bp, Zea mays
  Clone ID: LIB3279-227-Q6-K6-D9
ccacgcgtccgctcctcttcctgctgtgcgaaatcgagcacaccaaacccttcccaaaccctaatgcaggctattttacattcggatctgacccaaagctgctgtttttccatatgaaaggaacaacgcaagggatgctcgattggctctagttacttagcagaaccaaaagaggaaggccatcaaagatacgagggctttttctcgccatgtctcggtcgccacacctcccaccccgctgcccacccctgggtcctcagatcactcgaagggatgacagcatgttcacgcagagctgcaggtttccatctggggatacgttctttagtgagccaccgtgctggctcgatgatctccttgcagattccgggaaagctcccaagcttcctcctctcagaagggcctgtagcgattctgatgccatcttggatgctctgtcaacatttgaaagcccaatttgtcgaattgaggaaggcaatcaaatctctggtggtgaagctgatgacttgttggatgctggcgaaggtggtgaaagcggttctgtggtcgaagctagctgtgtttat

SEQ ID NO: 15808 - DNA, 491 bp, Zea mays
  unsure (1)..(491): unsure at all n locations; Clone ID: LIB3279-227-Q6-K6-E1
gtaacaggaatagctngaanaaagctgggttcgaccccgggagcagaacgtggacctcaacatctccacagctcccgacgaggatgagccagggaaacccgctggcaccttgttccctggaggcaacatggtggccgtgccgtgcgccaactgtcacctcctagtcatgctctgcatgtcctccccatcctgccccaactgcaagttcgtgcagccgctgccaccttctgttgtgccgcctgcctatccgaggctcggtgccgccgtcaagccgctggagaccctcagccttctccattaggcgcatgcacgcgcgctccactgggagaagcttgtagaaaggaggaaaccaaagttgagttgtgtggtgcatgggttagtattactattacctgggtaatgggtgtatgaatgtgaaatcatgcgtgcatataaaaaggggtacggtcggttgcacgaatcaaacaaatcaatcaaatctactttatttc

SEQ ID NO: 15809 - DNA, 647 bp, Zea mays
  unsure (1)..(647): unsure at all n locations; Clone ID: LIB3279-227-Q6-K6-E10
cgtcgtcaattgctacanctgcaaactagcgttaagaatatctgatgcatgttaaattggaatctgttgaagtttcttaaatcttaactgctatagtgcaattgggattttggtgaaaaccatttcgctgctcatgcttggatccataattcttgatgcacaaattacatgttaaatatgtccaatggatgaattacacatcgcgttactgtgtgatgtgcttggacagccaaatcacaatcactgccacagttgctaaacctacaattagtagaattacattgagaatagtctgtactattggaggtttatcttgtatttggtacttatcacatttctttgtctgatctgaatataattattatttaggtactagtaagcactactgtcgatggtctgctgctcctaccgcatactagttttattcagatattaattttcatggcctatttggaacggtactggggaacataaactagcatgacagattgactgactgatgcactccccctaggcccctacattgtagctatacagtattttttttgctctcttattgttactgttgcttatcaaaggacaaacattccccattatgccttgtttcttttgagtgttcaaatgcttattgagggttntatgttcta

SEQ ID NO: 15810 - DNA, 657 bp, Zea mays
  unsure (1)..(657): unsure at all n locations; Clone ID: LIB3279-227-Q6-K6-E11
cgcttcatcgccatcaagaagtcaagaagcacggcggcgacgcgcccagcaacaacctgagcgacgaggagagccggcagctggacaagaggtcccggcagatccagtcggagatccggacggtggggtacatccggcaccgcaacctgctgtcgctggcggcgcacgtgccgcgcccggactgccactacctggtgtacgagtacatgaagaacggcagcctgcaccaggcgctgaaagccgacaacgccgaggccgaggacggcagcagcggcagcggcaccggcgccggcgggctgtcgtggcccgcgcggctccgcgtggcggtgggagtggcggcggggctggagtacctccacgtctcccaccagccgcagatcatccaccgcgacctcaagcccgccaacatcctgctggacgacgacctggaggcccgcatcgcggacttcgggctggccaaggcgatgccggactcgcacactcacgtcacggcgtccaacgtggccggcacgctgggctacatcgcgccggagtactaccagacggtcaagttcacggccaagtgcgacgtgtacagcttcggngtcatcctggcggtgctggccacggngaaggagccgtccgaccagttcttcacgcagacggagaaggtggtcg

SEQ ID NO: 15811 - DNA, 645 bp, Zea mays
  Clone ID: LIB3279-227-Q6-K6-E12
ggccaacccaacccaacccaacccaccctgcctccctccccgttccccagtccccaccccgaccggctggtcctcctcctttccccgcgccatcctcgaggcatcgccggcgccgcaacttcgttcaggaggaagcccgcacccggccccgatccgatggccaacagcaacctcccgcggcgtatcatcaaggagacgcagcgactgctcagcgagccagcgccggggatcagcgcgtcgccctcggaggagaacatgcgctacttcaacgttatgatccttgggccggcgcagtcgccctatgaaggtggagtttttaagcttgaactctttttacctgaggaatatcccatggctgccccaaaggttaggtttctgaccaagatttatcatcccaacattgacaagcttggtaggatatgcctcgacattctcaaggacaaatggagcccagcacttcagattcgaacagttcttttgagtatacaggctctactgagtgcaccaaatccagatgaccctctctccgataacattgcaaagcactggaaatccaatgaggtagaagctgttgaaacagccaaggagtggactcgcctgtatgcgagcggtgcatgagagcgcagtgctgttctttgtgtaata

SEQ ID NO: 15812 - DNA, 673 bp, Zea mays
  Clone ID: LIB3279-227-Q6-K6-E2
gggcaatcgggctctgccgctcgtctctcctttcagcatccatcgccgctgcttgagctctgcctccacttatctactacagtctacaggtgaggtgattctcttctctctccacccaccatccgccaatcagcaccgattctctagagaggacaagtgtatctgccgctgagtgagggaagctcgttgcttcatcggttctagatactgcccgtgcaggctcttggctggaactaggaagtcatgttgagtggccacgccgtgacactgagcgagaggagcgcctccggtacgcgcttgatcgaggatgtagcgtgcgaggcaggcgatgaggaggaggcggacgccgccgcgagagttgtgtaccgggcctcgttccaagagctgatgcccaactaccttcagtacgacaccatcatctgggcactcatatccctgctgcttgtcctggcgtgggggatcgggctgctcctgcttctctacctgccgtacaagagatacgtgctgaagaaggatatcctatcccgccaactctttgtcaccgagagtaagatagtgtacaaggcgactaggccttcgtacttgccattcatggggatagttaagaaagagattaaagtacctctccatttgattgttgatgttataattgagcaaggctgtctacaatctg

SEQ ID NO: 15813 - DNA, 642 bp, Zea mays
  Clone ID: LIB3279-227-Q6-K6-E4
tctcattcgccggcgacgagcacccaccagaaacatagctgctttgggtatggaggcgctgtttgggagcaataaccatggcggccacaaggccgctgatttggcatcgcttataattgcccaggttgccttggaggtgccaaggttacttgggctccttgccatgattctgcataatgaaatctttacatctggtggagaccagaatttgattactaggattctgggcaaaagcgaagatgaaactaatcctgagaacaaagatgatggagagtccgatgatgataatgatgatgaaggagacgatgatgatgctgaaaacgaggaggaagatgatggtggtgatgagggatcagatgacaatgagaatgaggaagatgacgatggagatgatgatgatcctgcagccaatggcgaagggggaagcgatgacgacgaagatgatggtggagaggatgaagaggatgatgacgacgacgacgatgatggggacgatggcaatgaggaagaggaggaagaatctgaagaggatgatgatgatgatgatgaagtcccccaaccacctactaaaaagaggaaatgatcaacggctgcgacgagtggttgcttatacgcaggaatgctgcctgttcgtccctgcgc

SEQ ID NO: 15814 - DNA, 637 bp, Zea mays
  unsure (1)..(637): unsure at all n locations; Clone ID: LIB3279-227-Q6-K6-E5
gacccacgccgtccggctctgcntggnnagcctgtncnngttgtggtgggacccgcaccacnntcggtggcngnnagtgcagnncagcgggcttccgnnccgtgtnncggcgtcncccgcggccaggnnatgatatcnnngtccggggtggcgccctccatgtcnnggagatcgtgagnncctgccacnnggctgcgnnngccgcggcganngggagcgnngctgtcggnagggagggagaaaatcggnncggtggctttgcccatttcgcacggcggnccccggcgcggtgnngttcgccgggccgcgccccagcggggggcaccgaaaggagcaccgagnnctgtccacgtcgtgnngcggcggagcattgaaatggtgtgtagaaattcaaatagggtaccggnngtggttgaaaatttgggatgggtggagttagcancggtagggcccattttacgaacctcatcgtatatcgatgagttgttggaatcctctagcatagactcgagcatgggagtaatcacctcacaccactcgattgctttatgattgatgcacccgactaaagatgtaaaatggtttagaaattnnnnaanaaannnnannannanannnnnnnnannnnnanananaa

SEQ ID NO: 15815 - DNA, 367 bp, Zea mays
  unsure (1)..(367): unsure at all n locations; Clone ID: LIB3279-227-Q6-K6-E6
tcggtcgtggccatgatgatggaggtagaggcagtggtggccgaggaaggggtggagttggtgccaaaggtggtaacaaaggtgggggccgtggccgtggctaaatctggtggacacatgggagaatgccgctttttaaggcctgtaattgtgttgcatagattgcttaggacatgatgaatgaaccgagttggctggtcggtttgggggcaaaaaccagaatggttcctgtcttctggacattgaggaagcggcggcagtcaggcttgtcgctgttctcaaaaacggtttggttgatatcttatccaatctgttcagactgttcgttgttcgtagttgttccccctaaattttccactctaacnna

SEQ ID NO: 15816 - DNA, 640 bp, Zea mays
  unsure (1)..(640): unsure at all n locations; Clone ID: LIB3279-227-Q6-K6-E7
gtcagggnaaaatctgacctggaacacctattgcaatccgccccacaagtgagactgtcatgtatccatacttctccaaatggataagaagccacagagacttacccttgaggtgtaatcaatggtgtaatgttgttagatgggagtttagcaatcctactccattcataaggtacctcatttgttggcttgccaatgtagttatgctattctccctgcctgccttattatctcatgttctgcaagacgctcccatactgtctacctagcaaatttgtatagttcattgattgcatgttaatgtgttggcgataagagcacgaccagatcattgcctcacttgtcagctctcaatcaaggaactcgaattttcatttctaagcataagataatgaaatagcacttccttacaagcattattatttattctagaacatttgaataagtggtccaatggaaagattggtaataaaggcattgactacttgtcaccctgactccctgagtaattaaaatgttcaatatgctttttttacagtatccacaacacccaccatttgaactgatcttcttccttatattataagtttgagaactgcctacatctatttttcattaggtacagtctttaaaattaaac

SEQ ID NO: 15817 - DNA, 247 bp, Zea mays
  Clone ID: LIB3279-227-Q6-K6-E8
cccacgcgtccgcccaacgcgtccgtctaagacgcgagcggcccgccctttttttttttttttttttttttttttttttttttttttttttttttttttttttttttttttttttttttttttttttttttttttttttttttttttttttttttttttttttttttttttaattttttatttttttattaaaatattatacttttaaaatagttgttttgagacaataatttttattaatgtaata

SEQ ID NO: 15818 - DNA, 649 bp, Zea mays
  unsure (1)..(649): unsure at all n locations; Clone ID: LIB3279-227-Q6-K6-E9
gccaacggccttccggaccctcgctgcgtcgtcctcaccgccgacgctgcccgatccctcgtcgattccgtcgacgccttcctcttcgactgcgatggggtcatttggaagggagataagctcattgaaggggtcccagagacgatggagctacctgaggaaactggngaaagaaattagcttttgtaacaaacaactctagaaagtcaagaaggcaatactcaaagaaattcagatcacttggacttgaagttactgaggaagagatttttacatcatcgtttgcggcagccatgttcttgaagttaaataattttcctccagaaaagaaggtttatgttgttggtgaagatggaatcttggaagagctcaagttagctggttttgaatgttttggtggtccggaggatggcaagaaaaacataaagttggaggcggatttctactttgaacatgacaaaagtgttggagctgtcattgttggacttgatcagtacttcaattattataaaatgcagtatgcaagaacatgtataagtgagaaccctgactgccttttcattgcgaccaaccgtgatccaaccgggcatatgacatctgcccaagaatggccaggagctggagctatggttgctgcagtaagctgctc

SEQ ID NO: 15819 - DNA, 655 bp, Zea mays
  Clone ID: LIB3279-227-Q6-K6-F1
cggtcgcgtgggcggacgcgtggggcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtcctccccaacatcaacccggtgctcctgcccaagaagaccgctgagaaggcggcggccaaggaggccaagtcgcccaagaagccgctaagtcccccaagaaggcatagaggggcgcctttaccgctgtgatgttgaatgctcgtgttcagtagatctttacttctgtagtgtcgtcgttggtattggaactggttagta

SEQ ID NO: 15820 - DNA, 652 bp, Zea mays
  unsure (1)..(652): unsure at all n locations; Clone ID: LIB3279-227-Q6-K6-F10
aggagcagctcttacttaccagtgtgcctggaggcaaaggcttgccagaagggagctcaggaagctcaagatggcggcaagagaaacaggagccctaaaagaggccaaggataaacttgagaagcgtgttgaagaactcacctggcgcttaggattggagaagcgattaaggactgaccttgaggaagcaaaagcccaggaaattgctaagctgcaagagacgttgcatgatatgcagcttcaagttgaagagtcaaaggccatggtagttaaggagagggaagctgctagaaaggcaattgaagaagcacctccagtaattaaagagactcctgtgctagtcgaagacacagaaaagattaactcactgacgaccgaagttgaacaactaaaggctttgctgctaactgaaagacaagcaacagaagctgcaaaaagagaacacgctgaatctgaactgagaaatgaagaactaattaagaaatttgagagcgcagagaaaaagattgagcaacttcaggaaactgtccataggctggaggagaaagcaaccaacatggagtctgagaacaaagtgctccgtcaacaagctgttgcaatttcttctacgtcaaaatcattagctgcatatnctaagtctcctttccagctg

SEQ ID NO: 15821 - DNA, 538 bp, Zea mays
  Clone ID: LIB3279-227-Q6-K6-F11
cagcagctggctccaagggcgggcgatcgctggaagcttcgtcagccgcgtcctcgccggcaaggccgcctcgccgggagggccgtgcacgcctcggcgtacgacaagaacctggaggaacaggtgcgcccggcgttcgtgccggacgatgtgatcggcagcgccgggagccccgacaagtactggagcccccaccccaagaccggcgtgttcggcccggcggcggtggaccccaagctggcagctggtggcgcgccggacgccggcgcggatgctgcaggaggcacggtgctggaccagaaggtgtggttccgcccgctcgaggacgtcgagaagccgccccccgccgcgtgagccgcgcggcgctgctagcccagcccacactgctgctcgctcataaaaagggcggcgggagagcctggcaggcactctgctcgtgctcggctgggctggactccctgcttatatcactacaatattatactactagtagtggtgcttgatagcagtgtgtggctgtgctaataccagtataata

SEQ ID NO: 15822 - DNA, 626 bp, Zea mays
  Clone ID: LIB3279-227-Q6-K6-F12
cggacgcgtgggcggacgcgtgggggcgaagatggcgatgaccgtcgaagtgcttgctgcactcgcgttcatgttttccacgagtattctactgcagatactggcatgcgctttgtacaacaactggtggcccatgttagcagctctcatgtacgtccttgtaccaatgccatgcctgttttttggtggtggatccacacacttcttgaccagcagagaaggtggagggtggattaatgctgcaaaattcttgactggtgcgtcggccatgggaagccttgctattccagcaattctgaggcacgctggcttaatcgagaccggggccatgttcatcgagttcacgtccttcttcatccttgtatgcacagtgctgtgcttccatagggcgactctggatgaagactggtaaatgcgcatttcaccgtcaccctgaaccctagcggttcttggctgcttctgtccatgctaagaaaaattcctgttggaagctaacatggatctgtacaaaaaagcgtatttcgagcgtagccgtagctgatgtcttatgtagacacttgtgaagattatgtggtcatgtggcaatgcagatgttattaccttcactttgactttgtcgtcacatg

SEQ ID NO: 15823 - DNA, 534 bp, Zea mays
  unsure (1)..(534): unsure at all n locations; Clone ID: LIB3279-227-Q6-K6-F2
cccagcgtccgcggccgcgtgggcgcngaacacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatg

SEQ ID NO: 15824 - DNA, 620 bp, Zea mays
  unsure (1)..(620): unsure at all n locations; Clone ID: LIB3279-227-Q6-K6-F3
gtcgtgttcaaattctacgccagtgggagacgcttctgccagggcatgctcgccaccatggagatgcgggcgcggcacgacctgctgtcaaggttcgtcgagctggtcttccctgggaaggacaccattacgttcgaggtggtaatgaacgaagaggccatggaccatgtggttctggccgtggcccggaagaaggcagccaagacgctgcagaaagaggaaagggatctgcagaggtttgccaacgttctcacttcggcgcctgctgggaggaagtgggtgtcggatgagcttgctgtggtggctgagtcgaaggaggttgctggggatatgatcactgaggctgtgcttgatcaggttcttggtgagaaggcatttgagaaatttgggaagtggttcatctcgcttcgtttttcagaccagttggcaggatcttacaagaaggtccttgcattcaagtttgtattgccagatgcaagcaacatgtcagagatgacaagattagttgctcttgtgccatactacattgatttggttggccgttataagctcagntntcatgctcgctctaaaactgatggagctagaacaaaggctgttcagaggctttcagggaacta

SEQ ID NO: 15825 - DNA, 624 bp, Zea mays
  unsure (1)..(624): unsure at all n locations; Clone ID: LIB3279-227-Q6-K6-F4
gcaagtacagcggcgtngacatcgccttccgggtggaccagggctccaacccgttctacttcgaggtgctggtcgagttcgaggacggcgacggcgacctcagcgccgtcgacctcatggaggccgggtgcggcacatggaccccgatggtgcagaactggggcgcgctgtggcgctacaactccaactccggcaaggcgctgagcgcgcccttctcgctccggctcacctccgactccggcaaggtcctcgtcgccagcaatgtcatcccggccagctggaaggccggagggacgtaccgctccttggtgaattattacccttaaattacagctagctgggagcgtgatcgagggtgtgcttcggccttcgggaggcggcgttgcatgcatcctggcttttgcgagaggcggtgccagaagatgaggaggaggttgaggaatggaattcttccctctccctccacggtctctgcagtccctagtgatgtctgaacgtgctgttgatttctctgtaattttggttttttctctttttttttctttgtcgtcccgtagttgcgagaggcgcgacgagactgatgtcgcatgccaatttatcaagcctgtgtgtgttgtaccacgc

SEQ ID NO: 15826 - DNA, 495 bp, Zea mays
  Clone ID: LIB3279-227-Q6-K6-F5
atccaattggtttttgcataattgctgccattgctccaccaattgtatttcatggggaaatcattaactggtattctggctgcgattgacactttctctgaacatgtgataattgggatcttttactttgtggggtttgcactgttttgtctggagacactgctgagcattggggttcttcagaaagtgtacatgtacttcagagggaacaagtgaagccagtcatgatggagagttacgtttgttgagaaaatttggagttacttgtggctacttgtagcacatgttcattcgatggttttgtgcatacctgtcagtacaccttgaatctataatttcttatgtcagttattggtgccgagaattgtttttttaaggtggtatgggagtataggtttgcttacggatgggtgctgtggttcttcactagctattcttgaaacgcagaagatcatgcgcccaagtcatgtttcagaattaatttactgtactcat

SEQ ID NO: 15827 - DNA, 525 bp, Zea mays
  Clone ID: LIB3279-227-Q6-K6-F6
ccttccttcccgtctcttcttcccacttccttccacttcttgtccctgctcctgttggttttagcatcctgctcggccgaatgctggatcagaggctgcagcaaaggtagtaagtcgcttctcgtatttcccgtcgagagagggacagggggggagaacccccaaccgaggcgctgcaagttccccacggccggggcgggcttctcttgcgggaacatgaggaagctgttgttcatctccttcgtcctctcgctgtccgctgcagcagttcacggtgaagacggtaaggttcctcgcgctctctgttttgatccgttttatgcagttccggatgtgtttggccttttacgcgtgaatgcctgatgcatccatcttactcttcttgcttccgtatgcatggatggatcgatcgatctccacgttcgtgctcgctgcgttggttctcagctcagattttagtacgcctgcttcttgttttctcgttgcaatcatggagcatccacggagcgattgacagcagcggtc

SEQ ID NO: 15828 - DNA, 344 bp, Zea mays
  Clone ID: LIB3279-227-Q6-K6-F7
gcggccaggagggccacatctcccgcgactgccccacaaaggcgttaggcgcggcgccaccgtcgcgtcggatccggcggagtcccatgtcgcctctcgccgcttccctacccctccaaagtatcgctcggctgactcttgcgtgaagtcgtcggagcaaactatctatcagtagtactagcagtgtcgtttcgttttggtctgtcgtggcgtggtagtaagaaatgcaagtgagcagcaccagtatctttccgtttgaatcagttgtaaggcagtcatggtcatggttggctctgccggatctatctgtcatgaactatctatattatatcattatcaatgtt

SEQ ID NO: 15829 - DNA, 540 bp, Zea mays
  unsure (1)..(540): unsure at all n locations; Clone ID: LIB3279-227-Q6-K6-F8
ctcctcgcttttccttgcaaccgattgcctatccccctcccaaccaaaaaccgatggcgcccaagccgagaagaagcccgcggcngaagaagccggtggaggaggagcccgcggccgagaagacgaccgccgggaagaagcccaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctccttagcttgcacgctcgccctttgtaggcttctcttgtg

SEQ ID NO: 15830 - DNA, 647 bp, Zea mays
  Clone ID: LIB3279-227-Q6-K6-F9
cggacgcgtgggcgcgagctctccacccctccaacgaccctcctcggcggcggcggcggcgatgcagatggcggcgaccaccaccgagtcccaaccggccgtgccgcctcaacaccctcacgcccacccccacgcgcccccgcagcatgctcatccgcaccaccacatgccgcagccacggtgggtcgtcatcccgtacccgccgccgccgcccatggtggccgcgccaccaccaccgccgcagtttgccaagcacttcgctgctgggccgccgccgccgccccaagctggtgctgggcgccgcacgccgaccccgccctcgtctggatccggcgggaacgggtgcgaagaaaataaaaccatttgggtcggtgacctccagtactggatggatgaaaactacctacataactgcttcgggcccagcggcgaggtggttacaataaaagttatccgcaataggcaaacaggacagtcagaggggtatggatttgttgagttcttttctcatgcatcagcagagaaagctcttcagaattttactggtcatgtgatgccaaacactgaccgggcttttaaattgaactgggcctcgtttagcatgggtgaaaagcgatctgaagtgggttctgatcacttcgatattt

SEQ ID NO: 15831 - DNA, 501 bp, Zea mays
  Clone ID: LIB3279-227-Q6-K6-G1
ccccgcgtccgctctacttgggacattgaccatgtgaacctagagagagtttttctgcttcatactaccaaccaaattccctataagtctattatagtcttcgccgtattgtcctttcacctctgcttcatactaccaaccaaattccctataagtctattatagtcttcgccgtattgtcctttcacctctgtatcatagtcaacttattcttcaaaatcaatgtatccatcaaaatgtgaatcgaccatgtcaaatgtatccaatgctttgatttcatttttttatctactaatgaagttgcattagcttgataacatctcttcctctgagaaaactttgcaactaggttcataaaaggttggttgctttcttgataaattttcagtaaaattctgtgtatggaaagtaccaaccacagaatcaattaggaatccaaatagttgcatcacagtcatgtccacaatcatgtccacaatgtcttctagttctagatcgcga

SEQ ID NO: 15832 - DNA, 623 bp, Zea mays
  unsure (1)..(623): unsure at all n locations; Clone ID: LIB3279-227-Q6-K6-G10
cagtaagggacaaggcatatgaattgttgcaagaattgagagcaggccgcgatgcgaaaaagcacccttcatgcaaaatcgtacagttttagccaaagctagggattattctttgaggaatatgctatcagaattgcaagagctccacaagactgaggttgacaagttcatgagccaatggtgtgaaagtaaggccttcagagaggactatgagaagagaatcctcacctccctaaacagccgacagctgagtcgagatggtcggatgaggaatcctgacgagaagcccatatttatcgagtcacaggcgccagctccagagccagagccgttccctgtaaaattgcctgcaaaacaagccaaggaagtgcctgctcctcaggcagataatgcttccaagattgaagctccttcaaaaggacctgtccagttgcacaaggcaaaagctgctctcgatgctgatgatgattatgaggccgagcccccgaaggagaaggcaaaacctacggaggctgatgtggcgaagttgaaagagatgaagaggcaggaggagattgagaagaacaagcttgccttggagaggaagaagagcaggctgagaagaggcagcanaaactgtggcc

SEQ ID NO: 15833 - DNA, 623 bp, Zea mays
  unsure (1)..(623): unsure at all n locations; Clone ID: LIB3279-227-Q6-K6-G12
ctgacccatggccgcgaccaaggtgtgcaacgttaggttcgagggcaacgtgatcaccaccaccgtgacggcctccggcgcggccgtggagagctggctcgacgagatcctctccgtccaccgccgccgcctgcacaagctcgtcgtcgggctggacgtcgagtggcgccccagcttcagccgcgcctacagcaaaacagccatcgtccagctctgcgtcgggcgccgctgcctcatcttccagcttctccacgccgactacgtccccaacacgctggatgagttcctcagcgaccccgactacacattcgtcggcgtgggcgtggctgcggacgtcgagcggctcgagaacgactacgacctggaggtggcgaacgcggaggacctggccgaactcgcggcgaaggagatggggcgcccggacctccgcaacgcgggcctgcagggcatcgcgagagccgtcatggacgcccacgtcgagaagccgcagtgggtgaggacgggcccctggnacgcgtcatccctctccgacgagcagatcgagtacgccaccatcgacgcttttgtctctttcgaggttggccggatgctgctcagcggctactattgatcgatcgagccgt

SEQ ID NO: 15834 - DNA, 602 bp, Zea mays
  Clone ID: LIB3279-227-Q6-K6-G2
gcgtgaaagtgccagccacctagttctttcgccaatatgccaatttttattgttgtagctctaataggagctgctgttggcggattattagcacgccaaagaaaggcggaattgaagcggctcaataatcaacttcgccagatcaatgcagcacttagaaggcaggcacagattgagtcatttgcgcctggccttacttatgcgccagttgggagaacaaatgaaactgatgttattgttgacccaaggaagcagcagttggtcacaaacctgagaaatgggaagaattacatgaggaatcaagatcttgataaggctatagtggagttcagaacagctctggagcttgcagagagcataggtgatcgttttgaagaaaagaaagctgcccgaggactaggcgcatcgctgcagaggctcgggaagtaccgagaagcaatgagacagtacagcaaggttctggagctgtccaaggagacaggtgaagattccggttgcaccgaggcctacggtgccatagcggactgctacaccgagctgggcgacctggagcgagcggcgaagtgtatgacaagtacatatcgaggctgcagcccggcgag

SEQ ID NO: 15835 - DNA, 658 bp, Zea mays
  Clone ID: LIB3279-227-Q6-K6-G4
cggtcgcgtgggcggacgcgtgggcggacgcgtgggaattaatggcaacagtgatggggcctaccacttgtcattctcaggtggtaatgtgacagacagcctaccagattggcccgtggatgagttcttcagtaactcagaatatggtccaaactttggcttctccgagaatggttcttctaagggtgataacgctaagctggggggcgctggtggatctccacagtgccgtttggctgaaggctcagttgctgaggaactattagggcaggtgcctggattgatcaccgatgaatatatgagccgagtacctgagaattcatggacagtgcctgaggttccctctccaccaacagcctcggggctcaactggcacgggaatttgtgtttccctgcgtatgacagcaccatgttgttcctgaaattacctcccttcagaactccgaaagtcacttcaccgtaccttccagtttcaagcgccggagaagagagtactgagaggcgacaagaagatcactagacaccactgtccggtctaggctatcttgagaaaggcttcttggtgggctaaatgacgaaagaaatatccaggactgggtggtcattcaaacatcaactgagctatccagtagccaggttttaagtgtgttgtaatgct

SEQ ID NO: 15836 - DNA, 638 bp, Zea mays
  Clone ID: LIB3279-227-Q6-K6-G5
accccgggtcgcccagcgtccggaaggaatcactgtcacttggtgagatcgtggcccgcgtcgccgccgtcctcgttgctctcctcgccctctttgccgtcgcggccacggcgcagcccctgccgcgtcgcccaacgcgccccagcccctgcgccacccaagaggcccctctcccgccgccgccgaccagggcccccatggcctccccgccctcgcctcccacgatgtcgccggcgtccgcctcctccgccgacgctccagccacgagccccgtcggtgcgggatttggcgacgcgatggccccggcgggagcctccgctcttactccggccgccgcgcccgtcacggagaagagcacagccgcatctgcctccgccatcagcttcgtcgccatcgccggcgctgtggcagccgcagccgtcgtgttctagacatccggaggtggatctgaggagctgcagctgcagctgcacctgagccgctctgctgttgttgatagatgccctctgtttgctctgttttacgatccattgtttatttatttatttgtttgtttgtcatttagaggtctgagacagagatgaggatgtgtaatcctatcaattttctgacgggagttgtttctatgctcatataag

SEQ ID NO: 15837 - DNA, 653 bp, Zea mays
  Clone ID: LIB3279-227-Q6-K6-G6
gcaggaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggctttttatatccgtgtctaatctcgcaagtgctcgtgtttgcaactatacca

SEQ ID NO: 15838 - DNA, 652 bp, Zea mays
  unsure (1)..(652): unsure at all n locations; Clone ID: LIB3279-227-Q6-K6-G7
cgccacgcgcgcgtgatcttctgagcagaattccctggagccaagcaagtgagcgacggcatctccaaggccggcccggccctgctgtccggccccatcttcgccacgttcgagaaggtctccacgctgctccctgtcgtcgctgccgaggagccggccaaggaggccccggccccgcccgccactgaggaggcagccacgaaggaagcgcctgttgacgagaagaaagaggaagcccccgcccccgccgccgccgtcgagaagaaggaagagacccaagaagaggagaagaaagaagacacccctgcaccgcccgccgccgagactgctcctcctgctgatgcagcagctgctacagagcagcccgctgcggaggccgcggcagaagctgaggctccacctgcacctgccgtggcggagccggccaaggccgaggaggagacacccaaggcctagctagctagggttcagcaggttcatcttcttgcgcttgctgcccctagctagctagctggtgtaccgtgctctttaatcacgtcaccatccatattgttgttgcatatatatgcacacaatgttnttgttgctccagatgttattgctgtgcaaacccgtgttagatatttatgtatgtatatgtaagcctatatta

SEQ ID NO: 15839 - DNA, 669 bp, Zea mays
  unsure (1)..(669): unsure at all n locations; Clone ID: LIB3279-227-Q6-K6-G8
aaattcttcctctcctccatttcctcccttcgccatcatcccctcggctccgctttccttccctccccggctccccccgccgctgccccgcgcccgtggagttcttcgatcgagagtcctcggagcctgaagcacctcgtccaacaatccgggaccgcacgagaagagagagagggggtggtttgacacaagtcaggcacccgtcaagattcggctcgatctgctgcgggacatggagctggacagcatcgagtgcgtgtcctactccgacggcatggaggacgacgacgacacggccgccgtcacctcgtcccagctccctcgccccttcctcaaatcctcctctaccgccggtgctgccgccgccgccgccgcggccgtcaacgtggtcgtcgtctccgaccgcgccggtgccgccgggacggtagcgggagctgggccgctggtgatatctccggccacgggcgtgcatgagcttctcgagtgccccgtctgcaccaactccatgtacccgcccatccaccagtgccaaaatggtcatactctgtgttccacctgcaaaactcgggtgcacaaccgctgcccaacttgtcgacaggagctcggtgacatcaggtgtctggcattagaaaaagtggctgaatacttngagccccctgcagatctact

SEQ ID NO: 15840 - DNA, 499 bp, Zea mays
  Clone ID: LIB3279-227-Q6-K6-G9
gccaatacgaattacacgcttcctgggaggcccatctgcttgtggcccagacaaggcccacagtttagtgaacaatgtggcatgtaccttgctgagttcaagtcaggtgcatagaggaaggatgatgcggggagcaccatgaattcctacaaagttgctcaggtttcctctggctgttcaccattattggaagcagggcaggcagagagccttggaaccgaactcttggagatggtgcctagcagggaagatgagattaagttgaaagaatacagggaggatgttgtgtcgacttttatagttgatgattatgtgagacttgagtttaagggctcaacttttaccggttcttggaagtcatttagtagccctaagatttcatcaacattcttagtagtaattgctatagtatcaaatgggattgtggtacgagttgctcgagtactaacgttgttgtacattgtgaagctaagtgggtaatatcaaaagggattaagat

SEQ ID NO: 15841 - DNA, 613 bp, Zea mays
  Clone ID: LIB3279-227-Q6-K6-H1
gttccaccccaattccctcaagggatcgagatgaacaactccacctcgccggcggtggactggggtgacgactccgcgggggagatggactctgaggacgcagcgccttcctcctccatgggcatcagcatcgccattggcagcatgatggaggtcgacgccgacgaccgccaacccagtccgcctcccgacgccgacttcttcaacgccttccccgacgacttcgacgaccaagacctcgactgattgccgccgccgcttctttgctcgcccggaccccttccgccagttgggagtcgtatacgaacctacctacttccaaggaagcaccagtcatccatcaccttgtacatgtttttatgttgcagcactagtggtgtttaattgtcagctgcgatcatgtgagaacctgacctggtacattatgtatataagaagaataagaacctgttaacttatatggtatagtatgtaagttcatggcagaatgttcttgttggttggattcgtgcgcagttgagcagtgctggtgttgtaatgtgatggtcgcgactgcgttgttcgcatttgtgatggttttgcttttcattggtgaatggtgaatggtgaagac

SEQ ID NO: 15842 - DNA, 614 bp, Zea mays
  unsure (1)..(614): unsure at all n locations; Clone ID: LIB3279-227-Q6-K6-H10
gcgggacttggtgcctgcatccgagccctagacatggatcaacctgaggaaaaccctgaattcccaagctgtgatgcctactttgaagctatccagtccaagaagaagttgccactgactttgcaagaatcactaactgctgcctttgctcagattccagtctcatccttccctgaggttccagctggtcgagtaattgaaattcctggtgatacttctgttattgatgctgtaaggactctctctgaacagaacataagggcagcaccagtactgaatccagaacctggggctcctactgattggcaggggaggtaccttggtgtcatcgattactcggcaatcatcctttgggtactagaaaatgctgagcttgctgctgttgcactctcggctgcatcggcaactgctgctggagttggcatgggtgctgttggtgctgttggggtggcagctttgggaacaactggcccagctgctgtagctggcttaactgcagctgcaattggggcttctgttgctggtggattaactgctgaanagggtgtggcgaaggatgggctaactgctgcagatcatttaggggaggatttctacaaagttttacttcagca

SEQ ID NO: 15843 - DNA, 566 bp, Zea mays
  Clone ID: LIB3279-227-Q6-K6-H11
cccagcgtccggcgtttctcctaactgtttgccgatcgagcccgggcgacgtgagatacgagcggcgtcgaccggcgccggcgagcctccgcagccgcagccgcccgatctgggttttctttcgtagcggtagcggaagatgagccaggaccaggagaacggaggcaccaacgggcagcacgccgccgacgtgatggaggtggagccgaagcgccgggcgccgcggctgaacgagcgcatcctgtcgtcgctgtcgcggaggtccgtcgccgcgcacccctggcacgacctcgagatcggtcctgaagctccggccgtcttcaacgtcgtcgtggagatcaccaaggggagcaaggtgaagtacgagctggacaagaagacggggctcatcaaggtggaccggatcctctactcgtccgtcgtctaccctcacaactacggcttcgtgccccggacgctctgcgaggacaacgaccccatggacgtcctcgtgctcatgcaggaacccgtccttcccggcgccttcctccgcgccagggccatcggcctcatgcctatgatagatc

SEQ ID NO: 15844 - DNA, 186 bp, Zea mays
  Clone ID: LIB3279-227-Q6-K6-H12
gtgatacgagcgagttgtcttcttcccccccggagaaaatgcttccgagaataaattttttccatcggaatgtctgaaactatgttgggtgtatcctagtggttggttgagcattaatggctcatattttgtcaggtctatgtgtcgccgtgaaacttttaatcaaatcagttcactcttttgcct

SEQ ID NO: 15845 - DNA, 534 bp, Zea mays
  unsure (1)..(534): unsure at all n locations; Clone ID: LIB3279-227-Q6-K6-H2
ggcctacgacaggaacccgggcctcgccagcctgctcgtagaccccgagttcgcgcaggagatcatggacaggcaggcggcgtggcgcagggtggtgtgcctcgccatcaacaacggcgtcagcaccccgggaatgtccgctagcctggcctacttcgactcctaccgcagggacaggctgcctgccaacctggtgcaggcccagagggactacttcggggctcacacctacgagagggtcgacatgcctggctctttccacaccgagtggttcaagattgcgcgcaacatctccaacaactgatgagctgctcaacggatggcatgcccggtgttgactactccagtcggtaatgagatttcctgcaggaacttgtctattgatctttgtaagttaattatttatatgaataaaataagagcaaacatgcttgtgtttgggcaaaaaaaaaaaaaaaaaaagtctagatcgcgagcggccgccctnnnnnnnnnnnnnnnnnntntttttttttttttttttttttttttttt

SEQ ID NO: 15846 - DNA, 643 bp, Zea mays
  unsure (1)..(643): unsure at all n locations; Clone ID: LIB3279-227-Q6-K6-H3
gtctctcccaaacctagnacctattgtccttcctgttcaacctgcatagcggcggcgcgtcctgccttcagagagagagggagagagagcgcttgatctccgtaggcatggcatgggaggaggaggcggtagaagaggaggattacggggaggagatgtcggcttcggagtcggaggaggacgtcgtggtggggcagatgccgacggttatggtgccaaagcatatcaataagcgatccctgaagaacaaggcgctgtctgttaccctcgacaagaaagcgctcagggatttcgtgactgggttccacaagcggaagaaaaagagaagaaaggaggcgcagaagattttgcaggagaaggagaggaagaagaaaatacaagaccgcaagaggaggaaagaagagaaggagattgctctgtntggtagagtactgacatcggataaaaatgatggtgctggattagaaaacgaagatatcggcgatgatggtgaggatatggaaaatgacaaacctttgtctgaaatcaaaacctacgaagatgatgggaccagaactgtggtcaccaccagtggaaattactccttgaggaagatgacattgtctcggaaaactgtcgggtccgttggcgacgagccctcacc

SEQ ID NO: 15847 - DNA, 625 bp, Zea mays
  unsure (1)..(625): unsure at all n locations; Clone ID: LIB3279-227-Q6-K6-H4
cgccactctcactccgccacgccgngacacgccgctgcggcgcgcctgcgcccgctacacacgaggggactatggacacggtggctccccgcctgagtcgctcctcgacgcgatacgggcccatcagcagcagtgctgcctccttcagtgggcccgtccggaagtggcgcaaggcctgggtgcccctcaccggcaccggcaccggcaccgccgggtccgggggagggagctcacgaggagacaacaaggtggttctgtttagatggacgccggtgaatggttgctcaggaggagggggaggcaccgacgggnggcatggagctcgctgctgcgggggcctccacctgcaggcggcgctacgtcccggctgcaggggaggcgcaaagcaccaccaaaaagggcaccagcagcgagctcaacttgaacctcgagctggaagacccagacgacgacactgatgccgacatgagcaccgacacgcgatgtagaagataacagcgcccgtctagaaagccgcttgaagcggaaagcattttagccgctggtcacctagagatgcggatcggcctgaatcgtctgccctagctaggcggattntgtgtaacataatgtagcagcatgtaac

SEQ ID NO: 15848 - DNA, 593 bp, Zea mays
  Clone ID: LIB3279-227-Q6-K6-H5
tttatcattgcttgctaagtcagctttcgagttgctgaaatggaggattctacatcggccttttcttgaaactgctattacgtctattcttcctttagtcagtgatcctaactggcgtaccagatctgcactgttatcgtatctcaggacctttacctacaggcacacattcatactttctggctcagagaaatcacaaatctggcaaacaatagaaaatttacttgtggacaaccaagttgaggttagggagcatgctgctggtgttcttgcaagcttaatgaagggtatagatgaagatctatcaaaggatttccgtgaacggtcatatgcacaagcccagcatatttttgttgcacggagaagaaatttgaagttttctgttggtaccatccatggtgcagtccttgctttgacagcttcggtcctttctgttccatacgacatgcctagctggcttccttctaatgtctcgctacttgctcgcttcatccgggagcctccccccataagatcaacagtcacgaaagctgttgcagaatttaagcgcacccatgctgacacatggagcatccagaaggacgcattcactg

SEQ ID NO: 15849 - DNA, 621 bp, Zea mays
  unsure (1)..(621): unsure at all n locations; Clone ID: LIB3279-227-Q6-K6-H6
ggcccgtgtacatggtctccaacggatgcaccagattgcgcatcgccagagcttctccttcgtcgagaaggatggcggcgtgcgggtccgcacgggttggctcatgatggaactccgcctcgtcgaggacggcgccgccgggcagaaaccggaggaggacggcgacctcgggagtcgcgtcctgtgcaaggtgtaccgcagcccgcgcaaccccgagccaagcggcatcgaagccgcgacggcgcccgggcagaaggcggaggcagacgacaatgaatcttgcgacgacgaatctagcgacgcgacgttggacgacgatgacagctccaacgcgtcactagcggcggcatcgggacccaagagggaatccgacgaggtggaatccagcgacgcgacggtggcggcacctagtcgccatagcgcgccgaacgacgagatctccggccggtccgcggtggcgcccggacgcaaggaaaagacggagatcggnggaggtctccaccgagacgtccgcggcggtgcgcaagaggagaaaggccgacggcagcagctcccctggcacttccggtttctacgacggatatgcactgccctcggtgcggcacccatctcatgctaaca

SEQ ID NO: 15850 - DNA, 658 bp, Zea mays
  Clone ID: LIB3279-227-Q6-K6-H7
gttctctttctttttgtatggtttctattcgatgtcaggtgaaatctcttagcctcttttgaatgaaaatgtgtattgcttaaattttattactaagccataagacatgtttaggtactcttaggttaaagttgcatagtggccaggttcatatctgacaagcttaatcctctcttatacatatgaacttaattttgactaaacatgcatgtagtgtaattttatgaaacatatttaattatatattgttcttcagttcttgattgttgaaaatttatttctgaaatagtattacaaatggggggtaaggcttgtctcggttattcctttcactcacgtggagctgttagcactgggtctttctttcttctattacaaatggtaccagatccagcacttctgattctcgtttagctagccatgaagtaagcttgctgaactgtagcagatttcaagaaattgagttaatgcatatacacacatgaaggtggaccacctatatggttagtggtagtaagtcctatacgaccccactttattgagtcttgtagtcatatatgttaaactaggtaagcatggtggatggatcatctcttatttgtatgtagatgagatgcaattactgggggggtattttaaattcttctgactgcattat

SEQ ID NO: 15851 - DNA, 615 bp, Zea mays
  unsure (1)..(615): unsure at all n locations; Clone ID: LIB3279-227-Q6-K6-H8
tggtaananaagnaaaaaagnaaaaaaaaaatcaagnaggtttctcacgagtggtcattgatcaacaagcagaagcccatctggatgaggaagccagaagagatcacaaaggaagaatatgctgccttctacaaaagcttgacaaatgactgggaggagcatctggctgtgaagcacttctctgtggagggtcagctggagttcaaggctgttctctttgttcctaagagggccccgtttgatctcttcgacacaaggaagaagcaaaacaacatcaagctctatgtgcgcagggtgtttatcatggacaactgtgaggaactgatccctgagtggctgagttttgttaagggtattgttgactctgaggaccttcccctcaatatctcccgtgagactcttcagcagaacaagatcctgaaggtgatccggaagaaccttgtgaagaagtgtgttgagctcttctttgagattgctgaaaacaaggaggactacaacaagttttatgaggctttctccaagaacctcaagcttggcatccatgaggactcgcagaacaggggcaggattgctgagcttctgagataccactccacgaaaagcggtgatgagctg

SEQ ID NO: 15852 - DNA, 630 bp, Zea mays
  Clone ID: LIB3279-227-Q6-K6-H9
tttttattgagagcacacgaagatggcgaggcacccgagcgcgccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtcctcgtcgaggcctttctcgacccgctctgccccgacagccgcgacgcctggcagccgctgaagctcgccgtcgagcgatacgcgccgcgggtctcactcatcgtccacccgttcccactaccataccacacatatgcattctatgcctgccgcgcgctttacatagctaacaagttgaattcatcatcgacatatccattgctggagctgttcttcaagaaccaggaaaagttctacaattctgccacatcatctctctcgggcccttccgtagctctaggaatgtcgaagatggctgcgcagactgttggtaactcagtatccgagtttctgtcgggcttcagcgatgggaagacagactcggcagcgagagtttcattcaagtacgggtgcacgaggggagtctttggcgcgccgttcttctttgtgaatggctt

SEQ ID NO: 15853 - DNA, 589 bp, Zea mays
  Clone ID: LIB3279-227-Q6-N6-A1
gaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacaccccccctcggcagtccacctcactgactcaaataccgggtacagc

SEQ ID NO: 15854 - DNA, 555 bp, Zea mays
  Clone ID: LIB3279-227-Q6-N6-A10
atcacgagcacagggtgcaatcttaagccatcagaatacaataacagcttttgataattgtgatgccgtttcctgacaccgggcaacaccaacttaaaggtgaccatatatggcgtggacggcaaagaaaaatagacaagccggtaacagctaacacagttaaaacctcactgtcaatacaagagtttggtcattcttatttcttgttgcagcaaataggtctcaagggaaaaggaaaatcactgaaacaaccatataactcttttaagcgtgcaccagctcctgaaggtgtgctaatcagggctcagtggtggtccttcgtctcaaacaagccatcagggccccatgggaactccttgttgcggatgtgaagataggggtacgccggcggctcatcgaagtgggggtggcccttggacaggttgtacgccgccaggagggtgcaggtcacgatcccggcgtaggtgatcttctcccacttggccgtctcataggcgtcgtcgtggacggaggaggacatgcggcgcctcaacggggcggcgcgcaccgccagcg

SEQ ID NO: 15855 - DNA, 608 bp, Zea mays
  Clone ID: LIB3279-227-Q6-N6-A11
caggaataggttcagagctggttgcattattgtagggcaaacccatgcttcacaatattcagcaaatcacataacggtggtttacaacaaggcagtcacaaaaaaaccatggtaaataagtttccccctgcttctctctgatggaaaggagatatagatctcagatcatattcatcaaagtgccttgtcaaacagacaaaaaaccttctatggtctatcaccaagctcagctctcaagttgtcgtacgggtagactttgggagtatatggtatattggaggccttgtcgttcacaacagcagccataccgagggcagcgaagaaccctagccctccgcacagccacgccaacgcctcgtacttgccgatgtgcggggcaaggcggtcgatgcagggttccgggaagggcgtgccgttatcccataccaactcgtcgttcacggggaggggcttgtcggggacgatgtggcggccgacggggaggcccatgccggcgcggtgtcggagggcggaagccgcggcgcgtgcgccgccgccgcccaggatgcgggaccctgccgcggttagcctcccaccatctctcgcttgctcgctcaccgatctgtgcg

SEQ ID NO: 15856 - DNA, 597 bp, Zea mays
  Clone ID: LIB3279-227-Q6-N6-A12
agagaaaggatctctgaaattacacaaggatggagacagtgcagagtatcacattcagctgcagaaaaatgcaacttttaccgcggcataattctgcagcttcttatgcctaaacccactaaattgaaccatcattcatggtacgacacaggaacatggaagacggaagcaaaacagaacaggaacgaagacaaccgggaacaacaattttggaactatgatattgaaattttataacctaaatggccataaaagaaagcctatgatgttgtacaactgacgggggcacgaccatattcaacacaccttcccctttctgaccttcacatcgcaccatgctattcatctgctgctccaaatttgcagatagaagggaaacgaatcaactgctttcctccacagggcctgtgttcaggtttgcacttccttcaaccttggcggtggcagcggatcccttttcagctgaagcaccctcagttttgggggttgtcccactgttctcagtattcttcaactggacggccttggcaaatgcatctgatatgtcggccacaggatcttgagccttggtatccaccagtttctgagtatcggtgc

SEQ ID NO: 15857 - DNA, 572 bp, Zea mays
  Clone ID: LIB3279-227-Q6-N6-A3
accagatagtcatataataactaaataattatccaggtttgcacccttgaagttaacaactcaacacaaacagtgtccaaataactgaagcagtaccaggcaagcgttacacaggagaagggtcactccaacctgacagctcaactaaaacctacacgacgacaaggactcgcagaggagcacacagaaatgtccagtttaaactaacaatgtgcattccctagtcttcactccttggaggacttgttgatcagggacttgtggatgtgcgggatgacgcctccacctgcgatggtgcccttgatgagggtgtccagctcctcgtctccgcgaatggccaactgtaggtggcgaggggtgatacgcttcaccttcagatccttgctagcgttcccggccagctccaaaacctcggcagtcaagtactccaggatggcggcagagtagacggctgcagtggcaccaacgcggccatttgcctgagtcctttgcttcagctgacggtggattcgtccaacaggaaactggaggcccgcgcgggaggaccgtgagatgggggccttcttcccctt

SEQ ID NO: 15858 - DNA, 551 bp, Zea mays
  Clone ID: LIB3279-227-Q6-N6-A4
cccaccaaaagccggctgctcaccatcatactcaacagaccgtttacaagtgaaaccgttacagtgacatacccttgcatcgcaccaacccgttgaccgtagtgtttcagcagcgcaatctccgagtcggtttacaaacgcccacgcattgcatcagccatcaacatggcaaaccccagatgctctttatttctctaccgcctcttcgggggtttcactgaagatcctcctcctgtcgcctggcttcctgtagatgtcgtgcgacctgacggtttcagggcagactcccttggttttggcttcgagtttgcaggctgcccattctttgtgagaaaaagcctggctatccttgatggggccttattcgttctgctgtcgcctctgaagcaccacctacagaacactcggttcctgccactgagcagccatcatcagacatgttatctttgcattcggcctcgcctgatccagcagcccctgatagtcgtcggatctgttggctactgtcatttatatctgttgatgaacttggagacttggctttgtccttc

SEQ ID NO: 15859 - DNA, 619 bp, Zea mays
  Clone ID: LIB3279-227-Q6-N6-A5
aaatattcgagaacggaggtagtacaacataatagaagtcaccacaactagaagcacaagcacatactacaacataatagaagtcctcacaacttggatcaggtactacagcaatagtacttctcatgacactttatagttttcctagatcacatactacggttataaagttcctcccaatctgcataattctcagctgcccactctgcatcagttaaaccttcatagcaactgtcgtcctcaacctcaactgaatcatcacaactgggaggactaggctcatccatatccataagaccgcaaacagatgcttcttcttgtgacatctcttctactctcgacaacacttcattcaaattcattgtgcacaagtcgtagtgcttcatttccacaactgacgaatgacgtccgttttttacttctttgaacctacagaacgggatggttggatgaggtgctggacgcaggggattcgggggtgccaactggaaagaagttctggtagtgtaaatttctttctacatatattttcctggatgtcttgactgaaaggtggaagcaaatcctccaattctccaaaacttccaagcaactggaaagaaagtttctggtagtgtaa

SEQ ID NO: 15860 - DNA, 585 bp, Zea mays
  Clone ID: LIB3279-227-Q6-N6-A6
agtcgcagcaactcatccgatacttaaacgaaggcattgtatgcaagaaaaattgcccgactgacaaacgaagggcagactctatgaccataaatgtttttggggaccgatgtcaccacctagtaggatagttacgagtgtttggagatctaagtctccatccaaaacaaattgttggaagaatcctccctctacatgaattattaatttcttcgatatgaaaggcaaaaacttcaccagatcctgattggaaaggaccgggaacacacactgctcttgttcgtcatcatatttctccatttaagcaccgccggagccgtacttctttccgaagaagaggatctggagctggtcatagccagaaagcacaccagcaccagcaatggcacgaagaatgttagcaccagcacccttgaacagggacttgggcccttccttcttaagaatctgctggaacgcgtccaaggagctcttgtacttgacagcctcaccagatgtcatcatcatccttctgcggacggtatcgatggggtaagatgcaagaccagcaccattagtgatcagccaacccagagcgaaactggc

SEQ ID NO: 15861 - DNA, 521 bp, Zea mays
  unsure (1)..(521): unsure at all n locations; Clone ID: LIB3279-227-Q6-N6-A7
aatgaaattgaaaggcattgttattccagatgtcaatatacgcatcacttcaaaagtcacgggatatcagtcgcagtatatagagagacatctagcaaagtcgcaaccaaaaacaactgtatcttcggctccaactaacaacatcgaaagcgaacatcctccggtccttcaggtctcaagcagaccttgcactctttcttctcacctgcaaaattggtctccacgtcataaatgaatgcctggccgcgagtgcaccgacctcgcccactcagttgctggcattcgctgggaggtagtactggtagtatcccagcaccgcgaggagggcaaccagcacggcagccaccatggcagctgggccagcccatgaccagtaggactgcgccttcttcctcttcaggatcgccttgggtggcagggccttgctgaccacgttcctgtgccgggcactctccttctgttccttctttaccatggtggaaagctgggccacttcctgctncactggggcttccatggct

SEQ ID NO: 15862 - DNA, 321 bp, Zea mays
  Clone ID: LIB3279-227-Q6-N6-A8
aaatggaatataacacattaattctattgacttcagtttgatgtatatatatcattgaccacatgtcataaatacaccagaagaatgccgaaagttgttgttttgcgtctacattaattcacaagacacccacggtgcaaaactaaaacaaaaaaatgatggaaagctacagaggtctgcacattgaccaaagtgccaaaagcaatcgagagaatggcagataaataagaatcaatggcatcctcaggctcagccttgaactgtgaatcaatggaagtttcaggtgctcagacttgcacaattgaccaccaaggagctgcc

SEQ ID NO: 15863 - DNA, 598 bp, Zea mays
  unsure (1)..(598): unsure at all n locations; Clone ID: LIB3279-227-Q6-N6-A9
anacagggcttgagacctcagaagacgtttgatatttgataggataacacattctcaaaattccatgcttatgtcataacatggattggtacacaatactgatgtgaaagtcgtacagagatctttagcctaacaagatggcactaatctgacagcgagcaacttctacttggataacacagcagttggaaacagatacaagccagggtttcttaacctgacctgtatccaatacaaaggtaaacttcagtgctctttactcagggttgaccttttgcttctttgagtcctgatttttcttggcttcgcggcgctccctctttagtccctttacgtcgtttgataaggtcaactttccaacctgctggtctggcatgtagaccttgcccagcttgccctgcactggatccttggtgacatttttcatcttcttagcatgttcagcggtcttcatagcttctttcttcaaactttcagctggaagtctgtgcctccttacaaccagatccattgaaggtccaacttcgaccagctccatcctaggaatagatgtacctgacctttttagacggagagcacagtgcatcatgtagacagt

SEQ ID NO: 15864 - DNA, 444 bp, Zea mays
  Clone ID: LIB3279-227-Q6-N6-B1
ggaacaccaaccataccaaaatgttctttcaagcaaaagaaactttcctagttacaggtcctccgagttaaaagtctgacagagaaacaggaaataaataaccaaccaaaattactggtccacttttctaacaaatgctcacttcgttgcagttcatgggggggggagtaaatgtaaaatttaaagctttcgctcagctcaaactaccaaaagttcctccaggcaaaaaccaccagctacaactttaactgggccgaactataagtagatcaacggctcttcttgcttccttttgagctgctcttcgacgggctcgcaacgaggtagataaacaatccaacaaatgagacaacagacacaagtgacccatattttgccacaagccttttagcccattcaaacttttttttaagaagtctctcaacgagaatatccaatgggaaa

SEQ ID NO: 15865 - DNA, 480 bp, Zea mays
  Clone ID: LIB3279-227-Q6-N6-B10
atatctaaaaatttagccttaaataaggaataaaaaacagttattcatgtgccttagccttaaacatgaacaaacgaaaaacagttatgccctgaaacttattttgggcttttgttgggggttttaactccactgtagctttagaactaagctgacttaattgttgctgctaaagcagatgagaacgacaatatacagcggagtcaaatatatttgactggcacaacccgattctaatttcagcatgttcggtgcatcagaacctacaaggaatgctctccaacttcaccattagtttacagctggagaattttacaagagtccagattataagtcagtcacctcatgagaactacaaaattcacaatggacagaatggtttgattagacctacagcccactttagtttgtttgtactgatagctcatcctccaagaagttgtactcgaatgtgaagtcatttttgattctttggcacca

SEQ ID NO: 15866 - DNA, 495 bp, Zea mays
  Clone ID: LIB3279-227-Q6-N6-B11
tttttttttttttttttttttttttttttttttttttttttttttttttttttttttttttttttttttttttttttttttatttaaataaaatttttttaaaatttttttagggaaaaaaaaaaaaaaagggaaaaaaaggggggggagggggggggctaaaaaaaaaagggggaaaaaaaggggaaagagaaaggagcaggggcggaggagaaaaaaaaaaaaaaaaaaaaaaaaaagggaagaagaacaaaaaaacaaaaacgggagggggaagaagcgaaaccaaaaaaccccccaaaccaaggggaaaaaaaaaaagaaaaaaaaaacaccgaaagcaaagccaaagaaaaaaaaaaaaaaaaaaagaaggaaaaaaaaaaaaagaaaacaaaaagaaaggagagcgcgccaaaaaaaaaaaaaaaaaagggggtaccaaagaggaaccagcaaaaaaaagaaaaaggggggggaagaacccccccggag

SEQ ID NO: 15867 - DNA, 611 bp, Zea mays
  Clone ID: LIB3279-227-Q6-N6-B2
gagaactatggtggatgtcaacaacaacaacaacaaaagatccaagtacacttcagatctgcctcatttctatgtagctacaagtcaaaatggtcgacacagacatatgcaaagcctcttttcatttacccctgctactatctaaagtcgatatagggtacattcatgctagcgtactgtatttaatacacacacaaaaaaaatatgaaacagtgagcaagataaattaaacatcattcttgggatacatgaaccaaaagagtcgagcttacagcagcaaaaaggaaaccaaggttacttacttgctcattctccccgaactgtgattacatccatcttgcggattgcatccatatcgacattttgtgcattgcatatttgcatgcatatcatgttgtgggagcgcagttgctacggcccttgccatgacatgttccaactctgctcaagctccacatttggtaccaagttttgccacccccctaacatctccggctgctcacctattaacacttctatttcaaaggaagtaaaggaattgtccagcaaaaatattacattattccactcagccatacggatgggcgagtttcgaggaagcatgaaacaat

SEQ ID NO: 15868 - DNA, 323 bp, Zea mays
  Clone ID: LIB3279-227-Q6-N6-B3
gcgatctagactaatgtcatttttgggcttgctctgggttacaaatcagtcattatcccaatttttgctattgcgtttagtatcttccttagcttcagccttgctgccatgtatggtgttgctgtggctgctcttggaatgctgagtaccattgccacaggccttgctattgatgcctatggccctatcagtgataatgctggaggcatagctgaaatggctgggatgagccataggattcgtgagagaactgatgctctagatgctgcaggaaacaccactgctgcaattggaaagggttttgctattggctctgcagcctt

SEQ ID NO: 15869 - DNA, 521 bp, Zea mays
  Clone ID: LIB3279-227-Q6-N6-B5
tttttttttttgtttttttttttttttttttgttttttttttttttttttttttttttttttttttttttttttttttttttttttttttttttttttaaaattttaaaaaaaaaactataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaccagaccaaaaaaaccgaacaaaaaacctaaaacaaaaaaaaaaaaaaaaaaagaaccaaaaaaaaaaaaaaaaaatacaaattgaaaacaatatcccctcccaaaaaaacattccccaaaaacaaaaccccaaaaaagaaaacccaaaaaaaaaaaaaaaaagaaagaaaaaaaaaaaaaaaaacggagcaaaaaaaacggaccaaaatcaaaaaaaaaatcccaaaaccccaaccc

SEQ ID NO: 15870 - DNA, 388 bp, Zea mays
  Clone ID: LIB3279-227-Q6-N6-B6
gtcgccggccaccgtggcgttgagggccgcgaactcgggcaggctgatgaagccgtcgccgtccgcgtccgcctcggccatcatgcgcgccacctcgtcgtccgacgcgccgtggcccaggctctcgaacagcgccgccagctccgaccgcgagatccgcccgtcgccgttcgcgtcgaacttgcggaacacgcgcgccatctcctcctccgccgtcgcccgctccggggacccgctgccgtcgccgtcgcccgcggcaggcgcctgctgctgcggctgcggcggcggcggcttggaggagcggcggcggaacagggacggcacgggcatcctgatcttgcccatgtcgcgtggcgtgagggggctgcgactgcgagggggttcggct

SEQ ID NO: 15871 - DNA, 530 bp, Zea mays
  Clone ID: LIB3279-227-Q6-N6-B7
gtccaaaaaaatacaacaatagctagactagaaataacatcacatctcatattacaggcaacagaagactaagtagccaaaaccagttgccacccaaagaatgttctcaggtaccatataccatgccacgacgtctgccaccaaagcacatgaactggagggtgaatttcaaagaaaatgaccagtttcagacaaggcgacttatgtgcgttagtcaatggtgctcatttgtacagtgatatgccaccgttgatggcagaacaatcacttgcttattgtacagcagtttgcttcaggctatcttgtggcagctgagcacagggtacactacagtgttttcagttcgcaagtaattgctctgatcagctcagtccaacatgttgctaattcactcgcttgctttggctacatcagttttctttgcatcaacgtcctcatcaggagcttccttgactggttgctgcacatcagtgtcatgggcaacttgttcggaagaggcttccgagttagcaggctcactactattaaca

SEQ ID NO: 15872 - DNA, 615 bp, Zea mays
  Clone ID: LIB3279-227-Q6-N6-B8
gcgatctagaacgcccaccactacaccaccggcggcggcggcgacccagtcgagaacacgaaggcgatggcgacagcgctgaaccgcgggctccgctccgggctccgcctcctcgccgccggcgccgaggcgtccaagccagcttctcgtggattccatgccaccggcgtgaagagaatgggagggcatggccatgatgagccatactacatccatgccaagcacatgtataacttgcacaggatgaagcatcagggtttgaaggtgacactctccgtgctgggagcggttggcatcggtgttggagtccctgtgtatgcagtcatattccagcagaagaagactgcctctggctgagatgatgcctctcgctgcctgcatatggagacttgttttgagcgacatttttttgaagttaaaagcttggacttcatcctatcttggttgttgcctgatactgcattttcttaccataagttgtaacctcgtttcttgcggtttggtgtaggacacgacttttctgttaataatgttgtggcttgaactttccaggctgtggagattggtgaaaactcagcgctgatatcatttgttaaaaaaaaaaaaaaaggcggc

SEQ ID NO: 15873 - DNA, 473 bp, Zea mays
  Clone ID: LIB3279-227-Q6-N6-B9
gggaaaaaaaaatccgggggggggccaaaaaaaaaacccagggggggaaaggggcctaaaaaaaaaagcccatccccccccgttcaaaaaaaaaaaaaaaatccctttttaaaaaaaaaggccaaaatttgaaaaaacgggattgatcccggggggccaaaaacctttgggggaaaccacaaaagggggggggggctaaaaaaaaagggtggggaaaaaaaggggaaaaagaaaaaaaactccccaaaacccgggggggggcgggaaccccccttgggggggttcaaaaacgggcccaagaaggggccctaaaaaaaaaaagccccgtttttccaaaaaaaaaaaaaaaaaccgggggtgggggggggccccggaaaaaccccaaaccccttaaaaaaaaagtcccggaacccattcccaagccggggaaaaaggcgttaaagggaacgggggggccccccccagggggccgg

SEQ ID NO: 15874 - DNA, 567 bp, Zea mays
  Clone ID: LIB3279-227-Q6-N6-C10
acagcatagatcagcaaccatgtagtgaatgatagctgacccccccacatcaatccatacaatttttaaaacctatgtggaaggggggaggatcacagtgtgcatgggtacagcgtaaatgatgtacaaaattacagggaatctgttcaaactcaattcgatgttcactgctccagcgcgagctgcttgtgccggttgagatcgctgaggtagctcgagcgcgtgtaatcttctgaatcgcccgagtcaaacatcaggggcttcacgattttaggccttctcaccagctcaagtgactcccggtcacccttcaagaaacagactaccgatttcatactaggcctcgaggttgagctgtggtggatgcacaaggatgccactgctagtgtgtacaccatctcttcagggtcatactcgttaccaagggaaggatccaccagctcttggatgttgttcgcatcaagcagcggttttgcccatatcactaggctctgtctggatgagtccaccgctttccgcccggtaactagttcaagaagtagaactccatatgcgaacacatcggtc

SEQ ID NO: 15875 - DNA, 511 bp, Zea mays
  Clone ID: LIB3279-227-Q6-N6-C11
cacaaaccgaccaagtaaacagcagattaaccgcctccgctcgattttacacacgcacttttgcacacacgcccctcgcagacctcgcattacagaaaccaacccaacagacagccagagatcgcaaccgccagctctcctagcctactcgtcgtcgccgccgtcgccgccgaagagcgaggatcggtagtagagcagcgcgaggatgaggaggagcaagaacgcgacgccgaccggggaccctcccacgcggtggacggcgtcgggggacccgccgaaggcgaaggcgtcggcgagcgccgcggcgccgcggtcggacgagaggaggcggatgaggaacagcaggcacacggggaggaggagcagccccaccgggctcagcagctctgccacggcctccgtcagcgcctcgccgccgccgcccaggaacagcgggcccgccaccacgaggcccaccaccaccgccagcagcaggccgtggggcgcgccgcgctggcccggcccgccgtag

SEQ ID NO: 15876 - DNA, 598 bp, Zea mays
  Clone ID: LIB3279-227-Q6-N6-C12
ctcaaaaaaaaactaaactaatttcacttaaaaataaaaaccccttaagaaaatagggttctcaaaatagccctaagaaatgcaagaaatccggcacgttacacttctgtccacaacatagctttttgcagagattcagtacataaggattcttcaaattaaccataccacaccataacatgggacatttgcgaaactacgggtacaggtatcaaaatgcaacgagttcaatactaaaatataagcgtagggcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtcaagtacttcaggtacctcttggagaagggtccgtcagaggtgacggtgaccttggtcttctcgcgagagatggtgacggagtcgccgaggttgccagccttgccgccggcgaccttgatgcgctcctgcaggaacttctcgagcgaggcgacctccatgatcttgtcctccactggcttggtgcagccgatcgtgaaggaaaccgccccttt

SEQ ID NO: 15877 - DNA, 543 bp, Zea mays
  Clone ID: LIB3279-227-Q6-N6-C2
aacccacctgttaactgacccagataggtatgccatatcagattatcagtacaatatgttaattacagcgaatcacacattcttttgttttggcaacttgtttggaacagaatgcgaatagcccaacacaaagtacacatgtccagcgcttattaaagaaggggagtagtttgcattgggtctcatacaacctgatgatgcagtctccccaaccgacatttccagaacagttcttccttccttcgcagaggataaagggatacccgggcgtggacttgaatggggcgctaacagttccctcaggggggttgaaagcaacctcctggaaaggaccagccattttgccacgcgggaaccaaccaagatctccacctttcttccctgatgggcattcaaaatactcttgtgctaccttagcaaactcagcaggaggaactttgtccccattattcagccatccatcctgcaacttcttataagcttcattgatcttcccctggttttcacacaatacgtgcctagctttgacgtaggtgcaagtgc

SEQ ID NO: 15878 - DNA, 115 bp, Zea mays
  Clone ID: LIB3279-227-Q6-N6-C3
aacccccacccatctatttttatgaaaaaagggaaaaaggggtaaagggggggaaaggacccaccaaagggggcctttaagccccagggggggggcgaccaaaaactttaaaaac

SEQ ID NO: 15879 - DNA, 426 bp, Zea mays
  Clone ID: LIB3279-227-Q6-N6-C4
agacgaacattgcaattacttaataggtaggtcgatattagcagcaaataaagctccatcataataggttcacaaaacgactgactgatttgtcttagcacaaaactctggatatagctagaaaccacgatagatggcctactgaagtgcaggtttccaagacgagccattggacccatggcaaacggtgacgacgaactaggatgtgacatctctccatgaactcacgcatcgaagaaacgtaacacaactatgccgacaccaccatccacaatccccatcagcctacttggatctctgcctcatctttcggcgcttcctcttcagcctcctcatgcgcttcttcttccacttggccctcatagtcgcctccttgcgggctctccttggcgcgtctcctgctgctgcgtcggcggcgggttcacg

SEQ ID NO: 15880 - DNA, 608 bp, Zea mays
  Clone ID: LIB3279-227-Q6-N6-C5
ggttacacgaagagcgcacggttccttattttacattactccaataaggttattacaagcatccggacttttccccaacaagcatacatacatttatttctgctgtgatcatcagaagatgtattctggcacatcaagagggaaaggagccaccatgacttcgaacggcttcccttcaggtcggctcaacttgccaggcacaaacgaaaaagagccctccacagatccaggtacttggggcagtggcgtgcaactctcgtagacaaactcatcctcgccaggtaacagtagaggatactctccaataacccctcctccgctcacatcagaaacaaccctgtcacacgatctgatggtccagtggcgggagcaaagctggcaggaagaatagtacacgccacctagcatgcatgcctctggaactgacatgcgaattgagtaagtgaacataaatttttccccaggcctcccaggatgttctggcacaaagacagcagatgagcgtaccttaatgccatttgtaacagctgaactgcatgatggaggtgcttctggatataagctgatatatctcgatgccatcagcatacgggtcttgatcatgccac

SEQ ID NO: 15881 - DNA, 523 bp, Zea mays
  Clone ID: LIB3279-227-Q6-N6-C6
gtacagttgttgtactccaacaccatcaaaccaacagttgaccaactttatttattcctataagtatttgtagctaccgtgcgtatgttagccaacttgctccattcagattcagccgctcttcagtcctgctttgatccgcagcccttggggacggtgacgccgcactgtttggtaacgaagaacaccttgtccaggtctagcttattcctggcgtccggggagccgacgtagtcgcagatgcaggacgcgtgcgcgtctaaggccttgatggttttgcagcagtcctcggacggaggcatcttgggcccctccttctggacgaactgcttgcagctgcgccacagtgcgtctatgtcattctggcaggcagagacctgttggtcagctgacaccgctgctgctgctgcggaggccaggaggatgaggaggagcgtcgcagccatgtggccagcagggctcagctgggacatctccgtgtgcgcttctgctggactgggcgggacctcgatctactgattcg

SEQ ID NO: 15882 - DNA, 327 bp, Zea mays
  Clone ID: LIB3279-227-Q6-N6-C7
aaagtgcagaacacttgatgcaatatttagaccacgaacaaacgcaaggaatttctgatccataacagactgtcttagtaaaaaaaataaaattactcagtaaacaacaaccgaacgcagagagactccaggcggggacactccatgaatctgcctacttggacctctgcctcatctttcggcgcttcctcttaagccgcctcatccgctttttcttccacttggccctcatcgcggcgggatgactgcctctcggacgggtttggggggaaaccggaagagaggcctgtgcggacgcgtgggcggacgcgtgggcggacgcgtggg

SEQ ID NO: 15883 - DNA, 598 bp, Zea mays
  unsure (1)..(598): unsure at all n locations; Clone ID: LIB3279-227-Q6-N6-C8
gagcacaactagcaaagacagaagtttgatcagagatacaaatataataaaatacaanccagaaattacatgatttttgacaaccgtaccagttccacaatttataattaaaatgtgcaaattaggaagtagaaacttaacggtgaaaacatatcaaaatcactagtcgcgtgttgaattcaactcgcatctgtttaaccaatgtctccaaagatcacagatcagcccttcctgggtaccttgggaagggtataacatctctgatgttctccattccggttgcaaatagaatcatcctttcaaaacccaacccaaaaccactgtgctttacagatccaaagcgacggaggtccaagtaccattcatagggttccaaaggcaggccagcatcaagtatcctctgtttcagaacatctaaccgttcctccctttggcttccaccaatcaattcaccaaccttaggcacaagaacatccattgcagccaccgtcttgtcatcatcattgagtctcatataaaatgcctttattcctttcggatagttatagacaataactggcttcttaaatatatcctctgttaaatacctttcatgctc

SEQ ID NO: 15884 - DNA, 606 bp, Zea mays
  Clone ID: LIB3279-227-Q6-N6-C9
aagcaactagctggattcaataagcattgttactgttccatcagataacagttgctaccggaggagaccagacacagcagcacctaactacagcaagacacgcgaacatacgagggaagcctgcaagcggaggccacgcagcctaggacgaggtgaacttggtgacggccttggtgccctcggagacggcgtgcttggcgagctccccggggaggacgaggcgcacggaggtctggatctcacgggaggtgatggtgggcttcttgttgtaccgcgcgagcttggcggcctcggcggcgagcttctcgaagatgtcgttgatgaaggagttcatgatggacatggccttagaggagatgccgatgtccgggtgcacctgcttcagcaccttgaagatgtagatcttgtaggtctccacgctcttcttgcccttcttccggcccctctttccctcgccgccctccttgccggcggacttgcctgctgggacacgcttctccgccttgggcttcttcccggccggcgccttctcggcagcgggctcctcctccgccggcttcttcgccgcgggcttcttctcggccttgggcgccatcgatgcggggc

SEQ ID NO: 15885 - DNA, 492 bp, Zea mays
  Clone ID: LIB3279-227-Q6-N6-D10
ggagccagcactgccacagccacagagcacaacagctttagtatgacaagcataaaacaggcagcaaattgagaagatccctaaaaaaggcaaggccacgtacgggaacaaaacgcttaatttgatacccaggggcaaaagactaaaaagatttgccattagcagacttaaagatttcccacatggggggccccacaggatcacaagaaaaacagaaaccctggggatcctttttacatgcataacgcccaaaaacccaactggtgaacaaaggctggaagtcttaatggcatcacacgggtttcgggcgtaaccacctagggggacttgggacttcacatggaccacaagaggccagccacaaaaaagtcctttaacaaagcgcgatcactggccccacggactggtggttgctagttcttcgggaagggagcgttcaaaagcctggtgatctccaacaacccaaccttgtccctcccgccaaaaagcttt

SEQ ID NO: 15886 - DNA, 613 bp, Zea mays
  Clone ID: LIB3279-227-Q6-N6-D11
gacggaaaccctaaatatccacttaaatgcttttgcaaaaaaacacattagatagtaaaattgttgcgcgtcacattgtaggggcttttgagtagtagtagtagtagtactacattgcataatagtctgcgttcttggtacataaaagagtctctttgcttcagaaccgtcgcagtgaagctgccgagtatcatgaggtttatctatcctctcagccatgtgttcctgtaggacgagttgtcacgccgcgaagcatcatggggtttgtactccatcagatagctgtgcggcagcttgaggtgcctcttgatagaatccctcaatgccatcacagcctgatggtctgatgcgttccggttccagacgctcagaatgtcttcattgaaacggacactaagcacaacaccacagacatcatcgctatactcaagctggtcgcctactaccactagcaccaaatcctcccaaaatcgacctgaaactgcctttttgaatctaattatccacttgccaccattctggtttgcaggatcctcccagagggacggatgccatccttgaagagagaaggtcagtggggcttcgcagggaagaagggcgcgcaaggtggcaa

SEQ ID NO: 15887 - DNA, 502 bp, Zea mays
  Clone ID: LIB3279-227-Q6-N6-D12
gggaataaaaagcattattagctaaaaatacagtcttctgctccttgtattttctctgttcagcagatgggcaggggctcgccgttccactccttgaggcactcgagcaacgggtcgatgtgcttgccctggttgatggcaacgagcaccttgttcagctcctcgccgggagagcgcgttttctcgccggggaggtacacggctccgagctcctcgcgcacaaagcggtaaaacgggtaggagcggcagtcggcgattctgttcggtatccctgccgtgccgttctcgacagccgcccgtgcagcctccaccgccttgggcagcgccccacgcaggtcgtcctcgaactgggcgaccttggcgaacacggatgtctccgcgttgaactcggcagcgcccttggcgagggcgccctccacgagcacgttgcgaagcttcttcatcagtgggtagttagcgctgcaggggtcgtcggcatacccgaacaccgcctcgcgctcaa

SEQ ID NO: 15888 - DNA, 407 bp, Zea mays
  Clone ID: LIB3279-227-Q6-N6-D2
aaaaccaccatgcatattcttaaggggtattggaattggaaggcataaaaacaaaaagtaaatggcaaaaattagtggaaaatatctattttaagcaaataagtaaaaagttagctagctaatttaactagcaaatttttagccaactaactattagctatagggcattaaaacccccccaaaaaaaaaaatcggaaaaaacaaccctctataatggtaaaaattaacagccgcctcctagcagaaagggtaattccaccatttttagggagaataaaaccggggccaaaactactacggaactatcctactgtttccgcgaaaaaaaatgcctaatgtcccacccttgctgattgggggtattttctagcccaaaaatttaaacactgttctaccgaacccggggg

SEQ ID NO: 15889 - DNA, 425 bp, Zea mays
  Clone ID: LIB3279-227-Q6-N6-D4
ggggggggccccccccgaaaaggaaaaagaaaggggggggggggggggccccgccaaaaaaaaaaaaggccagtcccaccggggttttgggggttttgtaaaaaaaaaaggcccggggggtttaaagaagaaacaaaaaaggcccgggggggggggaaaaaaaggggaaccgccccttcctttaaggggggaaaaagaaaaaaaaaatccccccccccaaaagaaaaaaaaagggaaagaaaaagggttaaaaaaaagggggaaaaaaaaggggaaaaaccttcaaaaaaaacacccttggaaaagggttttaataaagggggccccaaaaaggggccccaaatccaaaaaggggggcccccaagaaaaaaaactttgggggaaacccaaataccaaaaaaaaagccctttttagggcccgaaaa

SEQ ID NO: 15890 - DNA, 459 bp, Zea mays
  Clone ID: LIB3279-227-Q6-N6-D5
ctgctgtctccggaattttattaatatcgtcacaatgtccagagaactgtcatctgagctatcaacaaacactagagcctcgtttctgcagcagccagcactagagccccgatcgatcgatcgatcaatcagtcagtcagttctcataagtcataaccatagggctcgaaaagagtcgcgcaggggtcgtcgtcgttctgcagcacgggggcggctcgctccatctcctccctgatgatccaaatggtctgcctgtcgacgacccggccgaggtcatggccggtctcgaacggatcctcgatgcacatcaggtggcggtcgcccccgacgcgcgtcgtccagcccttctcctgctttctgatcgtcttccccaggcggacggagatgacgtcgcgcttgtagcggtgctgggacccccagtagtggaagaacccccacagcagctcaccaatgctggcc

SEQ ID NO: 15891 - DNA, 617 bp, Zea mays
  Clone ID: LIB3279-227-Q6-N6-D6
caaaaaaagacgcccgttgatcttgaatttgattaacccaaaacctcaagtacagaatcaggaacagagacatatttacagtgttgtctaagtctcaaggtttgggaccagcagcagcatcccgtaactttcagggcgaactttcactctttcacactgctgcatgcacttgccaaactggaaataactccaactacataaaaaacaattgctttgcaagaatgacaagggaccaatatgccgacaggcgacagtattagtagacaattctcactccctcggttgttactcacagcctgaaaatcttgaaactctccaacaaaacaaaacaaaaatgtaagagctcttggggaccccaatgaatctaagaattggagattggactacagcaccatggtaactgaagaaatcttctatcctgcagtaaatatttacagcctacaggttttctttcagccactttgcagcaccattagcaattgacccagcaaaatgtgtaagtttcttcaaccaatcacccgctgctttagatttgtctgtatcttcttggctagcaccaacttctttctctagatgtacacgttttggctgggcaggttttggcttggcatctgttc

SEQ ID NO: 15892 - DNA, 130 bp, Zea mays
  Clone ID: LIB3279-227-Q6-N6-D7
gaaagcaggatagtgatttaacatcagatgtcaaattttcctacactacgataccatgacaagcaacaagctacattgatcccaaagctgtccatgatctaaacaacacaactaacagcatggagaagct

SEQ ID NO: 15893 - DNA, 537 bp, Zea mays
  Clone ID: LIB3279-227-Q6-N6-D8
agtaaaaggtattctatgccattcaatagtatcactctatacacgccatgtagggagttagttttttgtgctccaacagtcccttccacaaagggtaggtttacaaaaatgtttatccgagtgttctgtcgccctgttagagtaacaagacagcttgctacaaagaacatagcttctcactctcagtacacatagcttcctacaaagaacatagcttttcactcactcagtacacatgcaaaccaataatagacgaagtttgctcttgctcccaggacaaaatgggcgctctatgctatttcattggtattgcaagatacgaaggtccagaaaatacctatcatgaagggcttttttttttggtaaatcgtccccgttttcctcacaacaaactgtgatctttctaatattgtagaccaaggcaccaccaatgcgggccgtacatatcccatctcaactctctcaaacaacaatggtcgtactgaatgaaagctatttcactgcatataaattttgagtatgtttcagtataccaag

SEQ ID NO: 15894 - DNA, 612 bp, Zea mays
  Clone ID: LIB3279-227-Q6-N6-D9
ggacctccaaccaacacgtgggatggtatggtctgcaacttcactgcaattatgatggagcgtcaaacaaacgagtagaccgcaggccgctacacagcaaagccaccaaacagactccacttcaccactctacttgtaactactaataagctgacaacctcggtaaaattcccgcgaaagcggagaccgaaacaccctactctctcctactcaaagatgggcccctcaaaatctgtgcctgggtaaggttagcgaaaagttatctagggtaacgcgcctcggcctttcttctgacggtgggggtgggggttagggccggctgctgtcacaggccatagctgcctcttggggagccgccgttcaggctgagccttgccatgtcaggcatctgccagctgactgacgaagcatctgctccgaacgagaacgagcccgggtcgtaacaggaggccgtggcgcttctgctccggcgggcggacatccgcttcaacctttcggcttcgttctttagggcctgcgtctgaccatccttaatcagttttgcacgctgaagactagaaatctgtatcctcagctgcttgttttccatagatagagcattatgaagctgga

SEQ ID NO: 15895 - DNA, 491 bp, Zea mays
  Clone ID: LIB3279-227-Q6-N6-E1
gaaataaagtagatttgattgatttgtttgattcgtgcaaccgaccgtacccctttttatatgcacgcatgatttcacattcatacacccattacccaggtaatagtaatactaacccatgcaccacacaactcaactttggtttcctcctttctacaagcttctcccagtggagcgcgcgtgcatgcgcctaatggagaaggctgagggtctccagcggcttgacggcggcaccgagcctcggataggcaggcggcacaacagaaggtggcagcggctgcacgaacttgcagttggggcaggatggggaggacatgcagagcatgactaggaggtgacagttggcgcacggcacggccaccatgttgcctccagggaacaaggtgccagcgggtttccctggctcatcctcgtcgggagctgtggagatgttgaggtccacgttctgctcccggggtcgaacccagctcttcttcagcgtcttcctgttc

SEQ ID NO: 15896 - DNA, 572 bp, Zea mays
  Clone ID: LIB3279-227-Q6-N6-E10
agaaaacttaaacgcttccattgctggttcatcagaaagcgtcacattcattacaaaattatacaacgcagaaggaaagttcgtcatgttcttcgcaaggagtcatccaccatacatttgaagccaaaaggaaggggaaaatgcctgtataaactatgccagtgaaaccagcaaaagatttggtttatcgaacaccatcatggccgattgcctctgaaggaggaactagaagcaattgcaggagtttcttccctgtaaggctgggttgcaggatcactgacacttggtaatctttgcacactcccctttccttttcttgcgttggggccaatttcttcaatcatgtacttccatccatcgataggacgcctccgactaaaaatgtgggttttgatgaagctagcaatctgctgtttactaaaagcaattcgcctttcaaattcctgtattagaatgtcatcttctcgctgtgagatatcccatatgttcccatcctgtcctcttgaagtagtttcccaaccatcaggcttggttttgatctcagtagtgtttgggatcttggaatcaccaaa

SEQ ID NO: 15897 - DNA, 584 bp, Zea mays
  Clone ID: LIB3279-227-Q6-N6-E11
tttttttttttttttttttttttttttttttttttttttttttttttttttttttttttttttttttttttttttttttttggaccaaggagtagggagcattattggatttggacccttggacaaaaagaagggtcgaatttttaaagcaaagatactggacaaaggaacacgggaatcaaactgatatttcaggaaaagccataaaccatgccaatgctcgcgcatttcgcaagcaaagggaaagggaggaaaagcgaagatgtatcatgcacgtcctatttgagcgcgggcgcgggcgactccaaaagcaaaaaaggagctcgtataaatagtttaaagctaggggggaatgattaaactggctagggcttgatctggaaaagaatgcaagggacgtccttgggggggggcccctccttgggggcgtccttggggcaaaaaaaggggaagcgcaaaaacaacaggaactgcttgtcgaaaccggcgccggcaaagggggggtttatgggctgggcgtgctccccggccttaatgacgcggggcaaccacttgacgaggccgaccacctccttcgtttgggt

SEQ ID NO: 15898 - DNA, 602 bp, Zea mays
  Clone ID: LIB3279-227-Q6-N6-E12
acatgaagtgacaaatatattagagtaactgcaagttctaccacatatactgattagtcaaaggtgcccaaaggtaaagggaaccgaccacaggtgtacaaccaaacaattcagagtggtagtcatttagagacttcattccatggcaaatatctccagtctatttttatcaagcaaatggcaacggattaggactgaagtatgatggggttattacacaaagaacagcactgcgctctcatgcaccgctcgcatacaggcgagtccactccttggctgtttcaacagcttctacctcattggatttccagtgctttgcaatgttatcggagagagggtcatctggatttggtgcactcagtagagcctgtatactcaaaagaactgttcgaatctgaagtgctgggctccatttgtccttgagaatgtcgaggcatatcctaccaagcttgtcaatgttgggatgataaatcttggtcagaaacctaacctttggggcagccatgggatattcctcaggtaaaaagagttcaagcttaaaaactccaccttcatagggcgactgcgccggcccaaggatcataacgttgaagtagcgcatg

SEQ ID NO: 15899 - DNA, 578 bp, Zea mays
  Clone ID: LIB3279-227-Q6-N6-E2
aggattagaatgttgtattgatagctataaacatatatgggctgagcctaagcccattacagtacacgtattggcacagattaccattttagaatttatacagtaaacaagcttacatgtacgttgatctactttgtgaccctagaccactgtccactgattctgtgattctttgtacatcaaattgtgaaacttggaagaatcagcaagacctatgtacaacagataacttgtgaaacttgaatcaaactagaagctccttcacggcatgagcagctttgcaatttcccatggtatatgatctgaaggactaaatagaaaaacagagttcatatactccacttgttcctcctgttctttccatgtttaatttgagctaattttcaaagatgatataatatcagatcattctcttctatgtgatcttacgagtagagactcaagattcttcactgatcgattaagttcttcaatcttatggagcaatatattgtcagaaattttacccttagaatcaaaggcagcacagattggggaagctctgacctttgcactaggtgagtgtaatccactacttt

SEQ ID NO: 15900 - DNA, 566 bp, Zea mays
  Clone ID: LIB3279-227-Q6-N6-E4
agaaaccatgatagcaatctgagaaacatgattaaaggaatggtttaatagtacatgcacaattaaatgtttctttttcgtttccaaactaggctatgaattgtccacgaccaagctaaaaaactctacccactaaacagtaaactgctgcgcagggacgaacaggcagcattcctgcgtataagcaaccactcgtcgcagccgttgatcatttcctctttttagtagggggttgggggacttcatcatcatcatcatcatcctcttcagattcttcctcctcttcctcattgccatcgtccccatcatcgtcgtcgtcgtcatcatcctcttcatcctctccaccatcatcttcgtcgtcatcgcttcccccttcgccattggctgcaggatcatcatcatctccatcggcatcttcctcattctcattggcatctgatccctcatcaccaccatcatcttcctcctcgttttcagcatcatcatcggctccttcatcatcattatcatcatcggactctccatcatctttgttctcaggattagtttcatcttcgcttttgccc

SEQ ID NO: 15901 - DNA, 487 bp, Zea mays
  Clone ID: LIB3279-227-Q6-N6-E5
ctaaaccattttacatctttaggcgggggcctcaatcataaagcaatcgggggggggggggggattacccccatgcccgggtctatgctagggggttccaacaacccatcgatttacgaggggggcgtaaaagggccctaccgggctaactccacccatcccaaattcaaccacccggcccctattgaattctacacaccattatgctccgccgccacgacggggacaggtgggggctcctcgggccccccggtggggcgcccggggaaccaccgggccgtccgccgggcgaggggcagccaccgccgatttttcttcttcgacaggcgttcccttgccggggggcgcaaccggggcaggctcacaatctccgacatggagcgcaccccggacgatattatcctggccggggaccccgacacgggggagcccctggtgcactcgccaccgaggggggcgtccaccacaacgacaggctccaacaggc

SEQ ID NO: 15902 - DNA, 435 bp, Zea mays
  Clone ID: LIB3279-227-Q6-N6-E6
gtacaggggggaatttaaggggggaaaacctctaaaaaaaacacggggcagaaccgggggggcaaaaattccaccaagccgggaagaaaaaaaccgacaaggccggcggcccccccccccccaagggccaaaaaacagggaccatcccggatttggcccccaaaccgcacagccaagccggaaaaagcaccaaggcccaaggggaaaaagaaaaaaaaccacgggccggaaaaaaagggatgcccccaagggggcccccaatttggccccggccccggcccccaccgtcggcaccaccttgggcaccaacaccacccccgcccgggggaccacacccgggaactccaaaaaaagggccccccggcgaacgaccccggggttatacccggcgaaaaccggacccggacctgaagagggaccaagttgtcccaaagg

SEQ ID NO: 15903 - DNA, 586 bp, Zea mays
  Clone ID: LIB3279-227-Q6-N6-E7
aaaaggaatgtatgtcttctcatccttgcaacatcaaaactcggaagtaatgtccactggaatcaatggctttttttcagctgtgatgacatcagaactgcaagtcgatgtaaaaacaatgtaaatggattttccgatttgtatccaaaatctcgaagttacatggttcactactgaatccaaaaggactcccagcaaaggcaatcagtagctgcggccccaaaacgaccacttctttgctggctttccagatgcaaagcacagggtaccttctggaagttctggctgctcaaatggagtacacaatgttttcgcagctccgagttccccttttgtccgagctttcacatctttctcaacttcctcctcatcgcaccaaggagccaagatcaaccttttgttattcagagcagttgtgaattcatcccaagagttgacgacctgaacacatgcatctctcctttcttgagctgttttgaacagatttttttgaatctcatccaataacactttaacatcttcaaccaaattggtcaccggaatgtcaacctttgcaccgttgtcccggcggacaatgcgtacctaa

SEQ ID NO: 15904 - DNA, 335 bp, Zea mays
  Clone ID: LIB3279-227-Q6-N6-E8
ggagcatgaaaaagtcagtttcacggttgcaacgatgcgcacaatccaacatccagccagttcaacattgcaggttagttcaatcaactcgacatggcgcacaatgcgctgaccactctatgtacattcactcagattcccaaagccacaccaaatcagagtatttcatgattaggagatgaaagccctgacacactctgaaacgtcataaacatccccttgtctatggagggcttcaagaaactagccgagcctctggccttctctaaacagtaccactcacagcttgtttgttgcatccccaaatttcgcttgggcactgcgaacgctcctcc

SEQ ID NO: 15905 - DNA, 503 bp, Zea mays
  Clone ID: LIB3279-227-Q6-N6-E9
agcaacaaagtataacacgttgctttattacaattcgattctggacaatttcatactccaaccaatatattttccagcaagggaatcaagttgccagatttaaagctttacaatcacgcttacaagggtggcaaattgggctaatttggaggaatccaattgaaagattttgttactggcaaacaggttccccaaaaaaaggtgaaaattgttgtttcaagcacaagggcttcatgtaagcacaggttatccaaagcgtgctgagattgcgctgcaacgagaccaaggagaattacttttgcagtaacccaactagatcatacaccctgttcgtgtaaagatctggatggatattgttacgagcatcctgcacttttggtaaggcagggcaaccagacaaaacaaggagggtcttgcagccggtgttctggccaaatagtatgtccgtgtccagtctatcaccaaccatgcacatccttgacgtctccagattgaagcttttc

SEQ ID NO: 15906 - DNA, 550 bp, Zea mays
  Clone ID: LIB3279-227-Q6-N6-F1
gggcacccaaattgcaaattagatttctgaaatcagggaatcacgtttcaaccacaatgcacagatctactaaccagttccaataacaacgacgacactacagaagtaaagatctactgaacacgagcattcaacatcacagcggtaaaggcgcccctctatgccttcttgggggacttagcggccttcttgggcgacttggcctccttggccgccgccttctcagcggtcttcttgggcaggagcaccgggttgatgttggggaggacgccgccgtgggcgatggtgacgccggacagcagcttgccgagctcctcgtcgttgcggatggccaggagcacgtggcgcgggatgatgcgggtcttcttgttgtccttggcagcgttgccggccagctccagcacctcgggggccaggtactcgaggacggcggccaggtagacgggggcgcccgtgccgacgcgctgcgcgtaccggcccttcttcagataccgcccgatgcggccgacggggaactgcagcccggccttgacggacctcgtcaccgact

SEQ ID NO: 15907 - DNA, 579 bp, Zea mays
  Clone ID: LIB3279-227-Q6-N6-F10
atccatatgtaatatcactgtaatatctattttttcaactataatcgtctttgcaatttacaatatggcgatgatccatatgaagaaggcgacacaacgaacgactcggtagatgcggagaaccttttccacacgcttaactgtttaatgaccacgagcttttccaaaagcagctcggggaactgaccaggggcatccggccccttttcactacagtatggagaaacatagatgtggacccttcgcccaacaaaattgggagaggattgatgaaagaaccaaccaatcaaaccaaagacaatacatctaacaagccctggccagagagcaaaaggcacgagcgtatgtacacgagttatgcacaggttgagcggagaaaagaatgtgcaaaaagggacatgcagctggaaggaccaccctgttagtcctttctctggtgtaggaaggtgaacccagaattctcccgtatcagaggtggcatgtcgacatctgttacctcgatttctgtcatcgacttcgagatgtcgtccaccgaaaacggaatgctggaatcatcatccaacaggaacgaactgctga

SEQ ID NO: 15908 - DNA, 601 bp, Zea mays
  Clone ID: LIB3279-227-Q6-N6-F11
gcagaaaccatttgacccaagtacttataacactgaagacaccggtacatcacaggcacacatcgcctgcttgttcttattacaggcacgagcatcacgttgctactatcacaaccagtcctgatgcacgccatgcctgatacgactgattatagtagaaccagtattatactggtattagcacagccacacactgctatcaagcaccactactagtagtataatattgtagtgatataagcagggagtccagcccagccgagcacgagcagagtgcctgccaggctctcccgccgccctttttatgagcgagcagcagtgtgggctgggctagcagcgccgcgcggctcacgcggcggggggcggcttctcgacgtcctcgagcgggcggaaccacaccttctggtccagcaccgtgcctcctgcagcatccgcgccggcgtccggcgcgccaccagctgccagcttggggtccaccgccgccgggccgaacacgccggtcttggggtgggggctccagtacttgtcggggctcccggcgctgccgatcacatcgtccggcacgaacgccgggcgcacctgttcctccaggttcttgtcg

SEQ ID NO: 15909 - DNA, 634 bp, Zea mays
  Clone ID: LIB3279-227-Q6-N6-F12
acacggatgattccttccttcaccatagaacatgtgacgacaaagtcaaagtgaaggtaataacatctgcattgccacatgaccacataatcttcacaagtgtctacataagacatcagctacggctacgctcgaaatacgcttctttgtacagatccatgttagcttccaacaggaatttttcttagcatggacagaagcagccaagaaccgctagggttcagggtgacggtgaaatgcgcatttaccagtcttcatccagagtcgccctatggaagcacagcactgtgcatacaaggatgaagaaggacgtgaactcgatgaacatggccccggtctcgattaagccagcgtgcctcagaattgctggaatagcaaggcttcccatggccgacgcaccagtcaagaattttgcagcattaatccaccctccaccttctctgctggtcaagaagtgtgtggatccaccaccaaaaaacaggcatggcattggtacaaggacgtacatgagagctgctaacatgggccaccagttgttgtacaaagcgcatgccagtatctgcagtagaatactcgtggaaaacatgaacgcgagtgcagcaagcacttcgacggtcatcgccatcttcgcccc

SEQ ID NO: 15910 - DNA, 564 bp, Zea mays
  Clone ID: LIB3279-227-Q6-N6-F2
aaaaaaaagaaacacggtaatgatactgaaacgatcaacttccacgactcaccactcacgagcgaatacatctggatcaaagcacccactggccacacattactacatagagagagtacacagacagaagcgcacacatcggttcatgcctacgtactctgctcgcggcaacatgcatccacgatacaccgtttacgaactgtgtagacgattgctaaacaccataaatgactagagacaggcacacctcgatctagcttaaaataccagtagcattactttattactctccgccatgcatgcattcctcgcccggacgcgcacaggacgcctcatttaattaatcgtgttgcagttaacgttggtgctgatcttgtacggcagggcgacgccgcacttgctgggcagcgcggcggcgcggctgatgtaggtgccgctcccgttggcgccgttggcgacgttcttgaggcagccgcagatggtgcggcggtcgggggtgttgttggcctgctgcagcaggctgcggatgccgccgcaacacggctggggcggcatggccccgcc

SEQ ID NO: 15911 - DNA, 627 bp, Zea mays
  Clone ID: LIB3279-227-Q6-N6-F3
catatcatagttctatcaccattctacacattggaatcatgtaagttctatttctcatacagcacaggtcttgcataaccaaattttcttagaagttgcgtggggccacggataattctggcacacatccaataaaagccgaaacgccagtgaggattcttttctcctggatcctttttgctcattctcacaggattagaatataaatgagtctagcagacactgaactatatgctaatcaacaggtgaatagcaaaagccaagatatgatagattcttgaatcatgacgttgttaagagcggagcatcttcactttgggtccagacttcttcatttgccgagccctttccttttcttctttcttccggagtgactcagcgcttagtttggcatctgcctcctcgatgagtttcttcttttcagcctttttcctttgcagggcctcctgccgggcactctgtagttccctgaaagcctcctgagcagcctttgttctagctccatcagttttagagcgagcatgagagctgagcttataacggccaaccaaatcaatgtagtatggcacaagagcaactaatcttgtcatctctgacatgttgcttgcatctggcaatacaaacttg

SEQ ID NO: 15912 - DNA, 579 bp, Zea mays
  Clone ID: LIB3279-227-Q6-N6-F4
gagatagcacacagccgcaattcatttatatgaaaagattgcgtggtacaaacacacacagcttgataaattggcatgcgacatcagtctcgtcgcgcctctcgcaactacgggacgacaaagaaaaaaaagagaaaaaaacaaaattacagagaaataacagcacgttcagacatcactagggactgcagagaccgtggagggagagggaagaattccattcctcaacctcctcctcatcttctggcaccgcctctcgcaaaagccaggatgcatgcaacgccgcctcccgaaggccgaagcacaccctcgatcacgctcccagctagctgtaatttaagggtaataattcaccaaggagcggtacgtccctccggccttccagctggccgggatgacattgctggcgacgaggaccttgccggagtcggaggtgagccggagcgagaagggcgcgctcagcgccttgccggagttggagttgtagcgccacagcgcgccccagttctgcaccatcggggtccatgtgccgcacccggcctccatgaggtcgacggcgctgaggtcgccgtcgccgtc

SEQ ID NO: 15913 - DNA, 495 bp, Zea mays
  Clone ID: LIB3279-227-Q6-N6-F5
atgagtacagtaaattaattctgaaacatgacttgggcgcatgatcttctgcgtttcaagaatagctagtgaagaaccacagcacccatccgtaagcaaacctatactcccataccaccttaaaaaaacaattctcggcaccaataactgacataagaaattatagattcaaggtgtactgacaggtatgcacaaaaccatcgaatgaacatgtgctacaagtagccacaagtaactccaaattttctcaacaaacgtaactctccatcatgactggcttcacttgttccctctgaagtacatgtacactttctgaagaaccccaatgctcagcagtgtctccagacaaaacagtgcaaaccccacaaagtaaaagatcccaattatcacatgttcagagaaagtgtcaatcgcagccagaataccagttaatgatttcccatgaaatacaattggtggagcaatggcagcaattatgcaaaaaccaatgtggat

SEQ ID NO: 15914 - DNA, 511 bp, Zea mays
  Clone ID: LIB3279-227-Q6-N6-F6
attcttgaccgctgctgtcaatcgctccggggatgctccatgattgcaacgagaaaacaagaagcaggcgtactaaaatctgagctgagaaccaacgcagggagcacgaacgtggagatcgatcgatccatccatgcctacggaagcaagaagagtaagatgggtgcctcaggcattcacgcgtaaaaggccaaacacatccggaactgcataaaacggatcaaaacagagagcgcgaggaaccttaccgtcttcaccgggaactggtgcagcggacagcgagaggaccaaggagatgaacaacagcttcctcatgttcccgcaagaaaagcccgccccggccggggggaacttgcagcgcctcggttgggggttctccccccctgtccctttcttgacgggaaatacgagaagcgacttactacctttgctgcagcctctgatccaacattcggccgagcaggatgctaaaaccaacaggagcagggacaagaagtggaaggaagtggga

SEQ ID NO: 15915 - DNA, 347 bp, Zea mays
  Clone ID: LIB3279-227-Q6-N6-F7
aacattgataatgatataatatagatagttcatgacagatagatccggcagagccaaccatgaccatgactgccttacaactgattcaaacggaaagatactggtgctgctcacttgcatttcttactaccacgccacgacagaccaaaacgaaacgacactgctagtactactgatagatagtttgctccgacgacttcacgcaagagtcagccgagcgatacctttggaggggtagggaagcggcgagaggcgacatgggactccgccggatccgacgcgacggtggcgccgcgcctaacgccttttgttggggcagtcgcgggagatgtggccctcctggccgc

SEQ ID NO: 15916 - DNA, 518 bp, Zea mays
  Clone ID: LIB3279-227-Q6-N6-F8
agcggcaaactcaaaatttggaacataagggatcaacaacaaaggggtggtgattcacaaaaaaacaagtccttgctgggttacatgacgcagttcctacaaaagcagagcagcgccgacagaaaaaccagcaacatttaactacaacacaaggggaacatcaacacaagagaagcctacaaagggcgagcgtgcaagcctaggaggaggggaacttggggacggccttggggccctcaaaaacggggtgcttggcgagctccccggggagcaccaggcgcacggaggtctggatctcgcgggaggggatggggggctttttgttgtaacgcgcgagcttgggggcctcgccggccaactttttaaaaatgtcgttgatgaaggagttcatgatggacatggccttggaggaaatgcccatgtccgggtgcacctgcttcaacaccttgaagatgtaaatcttgtacgtctccacgctctttttgcccttcttcttgccacgcttggccttgccgccc

SEQ ID NO: 15917 - DNA, 621 bp, Zea mays
  Clone ID: LIB3279-227-Q6-N6-F9
ggacgcacaaacaatagtttaatttatttccaagtcaaaatttcttgaaagaataacatgactctctgatgtactacaacaagccacgagttccattccatccaattcttccggacgcacacggcacacacaacagttacaggcaccataacgataacgatgcaacaacatatctcgcccacttcttaggacagccttataaaggcaccttctcacctgacgctactatgctcaccggaccaaaacctttgtttcccgtcagaggggacacgtcggaggggagctctctagctcactagctgctggttgccatatagcgggtacgtgccatacgctgcagcgtacatgtttgggtgtggcaccggggaggcatagccatatccgccgtagaatggtgtgccatagtacatgttgttcctcctgttgacggagtcacccctagactgcttatgtgatgggctgcggacccatgaaaggcgaactgcctgctttccaatgagtgatccatttaatccttgtagtgcttcttcagcatcagttctgctaacaaattgaacaaagccacattgctttcctagaggaattttcacagaggcaagatcatatttggcaaaggctttt

SEQ ID NO: 15918 - DNA, 586 bp, Zea mays
  Clone ID: LIB3279-227-Q6-N6-G10
ttttttttttttttttttttttttttttttttttttttttttttttttttttttttttttttttttttttttttttttttttttttttttttttttttttttttttttttttttttttttttttttacccaaaaggggaaggggattatcccaaaggaaaaaaatggcccaaggaaaaaaaaccgggggaaaaaaaaaccggggtataaaaggggggggggggattaaaaaaaggcccaaaaaaaacaaaggggttttaaggcccccaaaaatataaaaaaacaaaaacggaaggggaaggggggtttccccctatccttaagggaaaaaaaaaaaacaaggccctttttttttcaaccggaaaaagggggccaaaaaaaaaaaaagggccgggggggggggaaaaaaaggccccaaacaaaaaaaaggggggaatcccgggggggggaaaccggggggtcccccccccccgggggggggggaaataaaaaaaaacccccaagggggggggggccccccaaaaaaaaagaaaaagggcccttttttctttaaaaaaacccctgggaagggggggccttgctccggg

SEQ ID NO: 15919 - DNA, 615 bp, Zea mays
  Clone ID: LIB3279-227-Q6-N6-G12
tgcattaacggctcgatcgatcaatagtagccgctgagcagcatccggccaacctcgaaagagacaaaagcgtcgatggtggcgtactcgatctgctcgtcggagagggatgacgcgtcccaggggcccgtcctcacccactgcggcttctcgacgtgggcgtccatgacggctctcgcgatgccctgcaggcccgcgttgcggaggtccgggcgccccatctccttcgccgcgagttcggccaggtcctccgcgttcgccacctccaggtcgtagtcgttctcgagccgctcgacgtccgcagccacgcccacgccgacgaatgtgtagtcggggtcgctgaggaactcatccagcgtgttggggacgtagtcggcgtggagaagctggaagatgaggcagcggcgcccgacgcagagctggacgatggctgttttgctgtaggcgcggctgaagctggggcgccactcgacgtccagcccgacgacgagcttgtgcaggcggcggcggtggacggagaggatctcgtcgagccagctctccacggccgcgccggaggccgtcacggtggtggtgatcacgttgccctcgaacctaacgttgcacaccttggtc

SEQ ID NO: 15920 - DNA, 477 bp, Zea mays
  Clone ID: LIB3279-227-Q6-N6-G2
ggggggggggggaagaaaaggggggggggggaaggaaaaaaaaaaaaggaaaagggagggggggaaggaaaaaaaaggggggggggggggggggggggggggggggggggggggggggggggggggggggggggggggggggaagaaggggggagggggggggggggcgggggggggggggggggggggggggggggggggggggggggggggggggagaaggggggaagggggggggggggggcggggggaagggggggggggggggggggggccgggggggggggaaaagggaaaggggggggggggcgggggggcccaaagggggggcggggggcgggggacccccccccggggcgtccctgtaaaaaaaggggggggggggggtcctggcccgagggggggatggatccgggggtataaccccaccccgggggttggagtaaaaaaggggggggggaaaaaacgttgcccgcc

SEQ ID NO: 15921 - DNA, 594 bp, Zea mays
  unsure (1)..(594): unsure at all n locations; Clone ID: LIB3279-227-Q6-N6-G4
actcatactgggtaccctttatttcgttatattatattatatacacaaaatcgacaccgtacagctcggaacaaatcacaagcgaagctcaggtctttggaaaatgaaacacattgaagcattacaacacacttaaaacctggctactggatagctcagttgatgtttgaatgaccacccagtcctggatattttctttcgtcatttagcccaccaagaagcctttctcaagatagcctagaccggacagtggtgtctagtgatcttcttgtcgcctctcagtactctcttctccggcgcttgaaactggaaggtacggtgaagtgactttcggagttctgaagggaggtaatttcaggaacaacatggtgctgtcatacgcagggaaacacaaattcccgtgccagttgagccccgaggctgttggtggagagggaacctcaggcactgtccatgaattctcaggtactcggctcatatattcatcggtgatcaatccaggcacctgccctaatagttcctcagcaactgagccttcagccaaacggcactgtnggagatccaccagcgccccccagcttagcgttatcaccc

SEQ ID NO: 15922 - DNA, 543 bp, Zea mays
  Clone ID: LIB3279-227-Q6-N6-G5
aatctgcttatatgagcatagaaacaactcccgtcagaaaattgataggattacacatcctcatctttgtctcagacctttaaatgacaaacaaacaaataaataaataaacaatgggtcgtaaaacagagcaaacagagggcatttatcaacaacagcagagcggctcaggtgcagctgcagctgcagctcctcaaatccacctccggatgtctagaacacgacggctgcggctgccacagcgccggcgatggcgacaaaactgatggcggaggcagatgcggctgtgctcttttccgtgacgggcgcggcggccggagtaagaacggaggctcccgccggggccatcgcgtcgccaaatcccgcaccgacggggctcgtggctggagcgtcggcggaggaggcggacgccggcgacatcgtgggaggcgagggcggggaggccatgggggccctggtcggcggcggcgggagaggggccatcttgggtggcgcaagggctggggcgcgcttgggcgacgcggcaggggcctgcgccgtggc

SEQ ID NO: 15923 - DNA, 591 bp, Zea mays
  Clone ID: LIB3279-227-Q6-N6-G6
gaatcgaatgacaagcatgataagttgacattataaatggtatagttgcaaacacgagcacttgcgagattagacacggatataagaagccaacgacggcatcacacgattacaggcgaacacaccaatcagcacaaacatcaccaaatcctttattctagtcactcagtgcagatgcagcctactgctagcagggcactgaacatcaccatcccgtcgtatggattctggtaagggaacagtatcccttcattcgatcttgtcgcagtcgatgtcgggggtgatgttgtaggacagcgagaggccgcagtcgccgggcagctcctgcgccgcggagagcacagcgtggacctgaacgtaggccgccttgaggcaccggcacgtggcctgcctgtcgggcctggtgtccgccgccgcgtacagggtcctcacgccgtcgcagcactggttgttgctctcgctgggtttggctgccttgccctgcaggaagggcaggcacggcgacaggtcgttgagcacgtcggagcacgagatgtcggccaccgcggactggactgccagcatcgccaccaggaggacgactgcaatgcc

SEQ ID NO: 15924 - DNA, 578 bp, Zea mays
  Clone ID: LIB3279-227-Q6-N6-G7
gaaccaaaactggcaataatatacatacctcctcacactgcatatgaatacgtagtggcaaaaaaaaaatataggcttacatatacatacataaatatctaacacgggtttgcacagcaataacatctggagcaacaaaaacattgtgtgcatatatatgcaacaacaatatggatggtgacgtgattaaagagcacggtacaccagctagctagctaggggcagcaagcgcaagaagatgaacctgctgaaccctagctagctaggccttgggtgtctcctcctcggccttggccggctccgccacggcaggtgcaggtggagcctcagcttctgccgcggcctccgcagcgggctgctctgtagcagctgctgcatcagcaggaggagcagtctcggcggcgggcggtgcaggggtgtcttctttcttctcctcttcttgggtctcttccttcttctcaacggcggcggcgggggcgggggcttcctctttcttctcgtcaacaggcgcttccttcgtggctgcctcctcagtggcgggcggggccggggcctccttggccggctcctcggcagcg

SEQ ID NO: 15925 - DNA, 591 bp, Zea mays
  Clone ID: LIB3279-227-Q6-N6-G8
actgcgcaacagtttatttccagacaacaaaatacaccgaggcaaacataacatcacaaatctgtatcgtcgagaaaaaaatgcttatcatgagattcaccagcccacaggaggaactctgtattttcattatcctgccaacaacctaactaatttagggcaggctgcaatggcagcttggcaaggacaaaacaccaagcacagacctggattcatccttgttactgcgctcagctgaacaaattgggaatgcaggcccccgagtcagggttctgctgctccttccagatacggcctgtgacgcgcagcttcagctctttcctatctccacctgagaagaagagagccatgttgcgctgaattattaggccgtcatggctgtccctaaccttccggtggctgtcccggatgctgcggggcgttccctcccatatcatcttcctgccatttgcaccaacctcaaggctatagctgtaattcctagaatcattttcgtcacccataaatcgtaggaaagccatgtatactggtgccaacccaagctgaaatgcctcaaagtgcaagcaaaagtactgcccaaaacaatgaaaa

SEQ ID NO: 15926 - DNA, 477 bp, Zea mays
  Clone ID: LIB3279-227-Q6-N6-G9
aaaactaaaaccctttgggttttccccccttagcttaaaaagggacaaaaacggtgggccccgggcaactcggcccaaaaccccattgggtcctttagcaattcccccaaaaaaggggggggaaaacttgggggtccaaaagggcctccaaaaaccgggaaaaggggggcccttaaacccaaggctcacaaaatcatcaactttaaaaggggccccaacacccccccgggattttttaaaaaaaaaccaaatttcccggggggggaccatttccaaaaggtggggtccaagggtttttggccgccctggttccaaaaagggggaacaccccaaggaaacccgggcaactttgggggaaataaggggggcccccgaaaaaaccttcctttttgcccccggcttgaacccaaaaagggccatgccacattggtcactaaactgggggccttgggggggccaaaaacaaaggggcccccc

SEQ ID NO: 15927 - DNA, 500 bp, Zea mays
  unsure (1)..(500): unsure at all n locations; Clone ID: LIB3279-227-Q6-N6-H1
gtcttcaccattcaccattcaccaatgaaaagcaaaaccatcacaaatgcgaacaacgcagtcgcgaccatcacattacaacaccagcactgctcaactgcgcacgaatccaaccaacaagaacattctgccatgaacttacatactataccatataagttaacaggttcttattcttcttatatacataatgtaccaggtcaggttctcacatgatcgcagctgacaattaaacaccactagtgctgcaacataaaaacatgtacaaggtgatggatgactggtgcttccttggaagtaggtaggttcgtatacgactcccaactggcggaaggggtccgggcgagcaaagaagcggcggcggcaatcagtcgaggtcttggtcgtcgaagtcgtcggggaaggcgttgaagaagtcggcgtcgggaggcggactgggttggncggtcgtcggcgtcgacctccatcatgctgccaatggcgatgctgatgcccatgga

SEQ ID NO: 15928 - DNA, 231 bp, Zea mays
  unsure (1)..(231): unsure at all n locations; Clone ID: LIB3279-227-Q6-N6-H10
gttcagaaaaccgtccaaagaaatgacatagtaaaatatttttaacagcacagaagccttgttacttaacctacacaggatttgctggattaacacgacacgaatgcaccgttnnccnaacncaaataaaccttcctcacatactgacctgttattatcaacattcacgctacagaaaagctcaaattttctccactgatctgactcctttcccctcaagcttctccatcg

SEQ ID NO: 15929 - DNA, 578 bp, Zea mays
  unsure (1)..(578): unsure at all n locations; Clone ID: LIB3279-227-Q6-N6-H11
attattaatctcatcgattcgttctggtagaaatgtagaagaggagtacatagatcaaaccacactgtggacagattccaccaaacccaaaagactataaataagggaagatacaggctaaaatcgctgggaagaagagatgcatggtcgtcgacaagccatgtgacctggctatccatgcatgagacgagaccacaaggattctgtcgatctgtgctcttgcgtcagctcagctcgcatgggatctggtaggacacgctctaccgccgcagggtctgcatgatgtactggccgtacaggtccatggagtactggatggcttcgcgggcagcggcggcgggcaggaagtcgttgacggccacctccttgttctcgttcttcttgtagtcttcgaagaagcggcggatctcctggaggcggtgaggggagagctcgctgatgtcgttgtagtggcggtactcggggtcgtcggcgcagacggcgatgatcttgtcgtccttctctccctgatctatcataggcatgaggccgatggccctggcgcggaggaagcgccgggaaggacnggttcctgcatg

SEQ ID NO: 15930 - DNA, 519 bp, Zea mays
  Clone ID: LIB3279-227-Q6-N6-H12
ggttaaaaagggaaccggagtctgatcaaaagggcccccgcgacccccacccccgcccaacaaagaccccctaaagcccaaccaaccgggggggggcacccaacacagacacagacacgccgaaggaaaaaaaggcgggcgcgggggcccccggccgcgggggggaagaaaacggcgcgcgcgggcccccgggcgcccggcgcgcccccccgaccccccccccggccccccccgcgggccccccccccccaacggggggcgggccagagcccggcgcaaacacggccacagccggggcccgggggaaattgggacccccacccaaacccccacaaaaaacgaacccgaaggggaaaccgaaaagcccggggggcccaaagagggagccaacccacaccaacgggcgggcgggcacggcccccggcccaaccgggaaacccaaggagccaaccacaataaaaaaaaggcccacccccggggggaggccgcgtggggaaacgggcccccggaggggtcccc

SEQ ID NO: 15931 - DNA, 495 bp, Zea mays
  Clone ID: LIB3279-227-Q6-N6-H2
tcgcgatctagaactgcaatagtcgccgtgttctttttagtacactagaataaatggatgttttttgtggacgcccatgttgaactagttttcttttccagtaagtacttcagaatgagtgagataaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccggaaaaaaaaaaattttttttttttttttttccaaaaaaaaaaaaaggggggtttttttttttttttcttaaaaaaatgccccccaaaaaaaaaaaaagcagttttttgggaaaaatttttttccccgggggggggaaaaacccccctttttcccctttgggaa

SEQ ID NO: 15932 - DNA, 566 bp, Zea mays
  Clone ID: LIB3279-227-Q6-N6-H3
gcggaacaaatgatcatcaatttattaccaaacaaactgcagatcaggggatgcgagattaaccacaggtccacagccagggacagcataattcttcctacagagggttcacaaaacactacttcattcccttgcccttccttttaccctttgcagcaccccgctttttggcaccccttttcgctctagccttgctcttgaacgttctcttcgggggcttccttttcacacctaaactggtgttcttcttggcaaaagagctaggattcttgctggggaggctcgtcgccacggggcccacagttttcgggacaatgtcatcttcttcaggagtaatttcactgggggggactaccgttctgggcccatcatcttcgtaggttttgatttcaaacaaagggttggcattttccatatcctcaccatcatcgccgatatcttcgttttctaatccagcaccatcatttttatccgatgtcagtactctaccatacagagcaatctccttctcttctttcctcctcttgcgggcttggattttcttcttcctctccttctcctgcaaa

SEQ ID NO: 15933 - DNA, 575 bp, Zea mays
  Clone ID: LIB3279-227-Q6-N6-H4
acaggacaaagtggcaagtcataaccaacagctatgaaatataacatgagcacttggacttgaacagtcatggacaatgccattgttctaaactggaacagacgaaggacgacgaggtggcggatacaagttacatgctgctacattatgttacacaaaatccgcctagctagggcagacgattcaggccgatccgcatctctaggtgaccagcggctaaaatgctttccgcttcaagcggctttctagacgggcgctgttatcttctacatcgcgtgtcggtgctcatgtcggcatcagtgtcgtcgtctgggtcttccagctcgaggttcaagttgagctcgctgctggtgccctttttggtggtgctttgcgcctcccctgcagccgggacgtagcgccgcctgcaggtggaggcccccgcagcagcgagctccatgcccccgtcggtgcctccccctcctcctgagcaaccattcaccggcgtccatctaaacagaaccaccttgttgtcttcctcgtgagctccctcccccggacccggcggtgccggtgccggtgcccgtgaggggcac

SEQ ID NO: 15934 - DNA, 607 bp, Zea mays
  unsure (1)..(607): unsure at all n locations; Clone ID: LIB3279-227-Q6-N6-H5
gccataatgcttccgctatgtccagacggtatacagtagactgcataacttcatctcagttgtacgaaggcatctgttgatgaaataaaactaggtacgtacaaggatatactttatgaaaaacaccgacacttcaacagttataaattcatatacacaacaccagtaccagagaatatcctatggcctttgaaattttaatctaagcgaagtacgacgaggaggaagatgtatcacggagaacctccagttcgtcttcagtgaatgcgtccttctggatgctccatgtgtcagcatgggtgcgcttaaattctgcaacagctttcgtgactgttgatcttatggggggaggctcccggatgaagcgagcaagtagcgagacattagaaggaagccagctaggcatgtcgtatggaacagaaaggaccgaagctgtcaaagcaaggactgcaccatggatggtaccaacagaaaacttcaaatttcttctccgtgcaacaaaaatatgctgnggcttgtgcatatgaaccgttcacggaaatcctttgatagatcttcatctatacccttcattaagcttgcaagaacaccagcagcatgctcccta

SEQ ID NO: 15935 - DNA, 593 bp, Zea mays
  Clone ID: LIB3279-227-Q6-N6-H6
gcatgactgtgtaaattcgtacgccttatgtcttggtttcacgattacatcaccgttgcagcaatagacacggttacttctaacgaattcttaatccaaaatcttcttatttcgttcttccaaataacagacgagaaaccatggctctgtttcccaggatttgtctgggcaggaaggaaccctggatctcacaggaactgatggaaccgaacccgaacatccttctgtgaagactcacccgtcccgccttgatcaggcgcggcggtggccgactcgtccttcgcgagccccgtttccgatttggactccgccatgttcagtgttagcatgagatgggtgccgcaccgagggcagtgcatatccgtcgtagaaaccggagtgccaggggagctgctgccgtcggcctttctcctcttgcgcaccgccgcggacgtctcggtggagacctccccgatctccgtcttttccttgcgtccgggcgccaccgcggaccggccggagatctcgtcgttcggcgcgctatggcgactaggtgccgccaccgtcgcgtcgctggattccacctcgtcggattccctcttgggtcccgatgc

SEQ ID NO: 15936 - DNA, 605 bp, Zea mays
  Clone ID: LIB3279-227-Q6-N6-H7
ccgaacataatcttcaaatgtttagtgatataaatcaaattgtcatattctccaacctccgaaatataatcttcaaatgtttagtgccttatccatccagataaggcatattctccaaaaaaaaattgggcacattctccaacgcaggatgaaacccaacccaaaaaaaacatcatggctctactatagagattcctgtcacagcctacatagaattatgaatatgatccagaaaacaaatgtcagctgcttccagagagcatatatataaggtaagacgcccgctgcttcatttttcctgtcatggttacccagcagaccggatgaacagcgtgatggtatccaagataattagtgccttatccatccagataaatgagtgggcaaaaggcccgcccacaagattcctttgcatgagctgtgcttgatctgctagtcttcaaaaatggtggtgacaaggagatgctggacaaaagctgatctcacagcagctctcctcctcctacgctccctctcttcatgactaagggtggaatcaacagttctgaaaaaaatgtttgcattaacataaaataatgcagtcagaagaatttaaaatacccccc

SEQ ID NO: 15937 - DNA, 589 bp, Zea mays
  Clone ID: LIB3279-227-Q6-N6-H8
acagataacaagaacaaactgtaaaacagagtaccatatagctatacaacaaactcattgcctggccggcaggagaaccgttaacgtgcggaaaacctcaaacagtagtcaagatttagcttatcatatgtaattagggataaacgacagtgatccgaagcttagtcgacctcctccatcttgctttcgccggcgtcatcctccagcggaggcatctcagcttcggcctcagcagactcgtcctcatcgatgctcagaccgagctttagcatgcgatggatccgggtgccaaaggtgttggggtcatccaggctgaagccggaggtcaggagagctgtctcgaacagcaacatcacaagatccttgactgacttgtcattcttgtcagcctcggcgcgcttacggagctcatccatgattgggttctccgggttgatttccatagtctttttgctcgacatgtaccccgacatgctagagtccctcagggcctgcgccttcatgatcctctccatgttggctgtccagccatactcaccagtgacaaggcagcacggtgagtccacaacacggtcagacaccacaacct

SEQ ID NO: 15938 - DNA, 602 bp, Zea mays
  Clone ID: LIB3279-227-Q6-N6-H9
aggatcatgcgaagtttaacatatcgtaggctccaatgcaagagcttcttcacatacttacccgatatactagctagcacacaactgctagcttaacagtacaacgagcaaagtgggatgctatttaccactgcagagcttacacacagtttgcaattgcataatagctgtttgcttgtccgccgtcggcactagcgaaacatctgtacgaccgtatcctctgtagcaaggccacttcaatcacttacatcgaagtaaacatctcgatccgttcaccgttctgggaaacaagggggtctaggatgccgatccacgtgctgtagtcgataggcgatccgcccccaggctggaggaagccattcacaaagaagaacggcgcgccaaagactcccctcgtgcacccgtacttgaatgaaactctcgctgccgagtctgtcttcccatcgctgaagcccgacagaaactcggatactgagttaccaacagtctgcgcagccatcttcgacattcctagagctacggaagggcccgagagaaatgatgtggcagaattgtagaacttttcctggttcttgaagaacagctccagcatggatatgtcg

SEQ ID NO: 15939 - DNA, 626 bp, Zea mays
  Clone ID: LIB3279-228-Q6-K6-A1
atctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgt

SEQ ID NO: 15940 - DNA, 658 bp, Zea mays
  unsure (1)..(658): unsure at all n locations; Clone ID: LIB3279-228-Q6-K6-A10
ngatgacatccctgaagagatggttcctatggttgtggtgaagagttgaagaagatttaaatgatgatactgaacactcttctggcattaggattgataatgcagatgataaggttaataacaataaatcaagcactacatgtgatgacaatgataaagttgttcagcctcctgctgcaagggccatgagaatagaacatggtgtgcccatggatgacagtaatcaaatttcttctctttcaaaagtggatgatacctctaaaatgcagagcaacagttcattcacagatcatatacaaaaaccaaatgctgattcatcatatttgagtgcaaagtttacagagaaaactggcggctcaacttatgaaagcaaaaggaactcatgggggcgtacttcagcaagaaaaggcttgtcaacagaggaggctggctgttgcagtgataatgacgaggctcatattgcgaagcttgaaaacaagaagacccatctccaatctaaacttacggaggaggtaaaagaaaaacagtcctccaggcaaatttagaaaggcgaaaagcagcactacatgaagcgtcgtgtagcacttgaaaaagagtggaaaattacgagaccagctgcagaaggagagaaaatttgaggcttcattggagtctgggt

SEQ ID NO: 15941 - DNA, 628 bp, Zea mays
  unsure (1)..(628): unsure at all n locations; Clone ID: LIB3279-228-Q6-K6-A11
cggagaacatcatccgcgccacgcgcacgcagaacgtgctcggcgangaaggccgtaggatcagggagctcacctccgtcgtccagaagaggttcaacttccctgagaatggcgtagagctttacgccgagaaggtcgtcaaccgtggcctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtgaacgagtacattgactcggctgtgagacacgttcttctcagacagggtgttcttggcatcaaggtgaagatcatgcttgactgggacccgaaggcaaggttggcccgatcactcctcttccggacctggtgaccatccacaccccgaaggacgaggacgagccgcgccctccggtcttggcacctcctggggtgtaaggtcccaactgtgtccttgaaatggcagtttgatcgggtcctanataggtttctatcttacgataaggacaatgc

SEQ ID NO: 15942 - DNA, 630 bp, Zea mays
  unsure (1)..(630): unsure at all n locations; Clone ID: LIB3279-228-Q6-K6-A12
cccagcgtccgcggacgcgtgggcgggctgttatactgtaaggtatgcccatagttagatttctgatagtttggatcggcaaagaagcttatagcttctcataaaagagctgaaactgaaactggaagtcatatcgttgctaaacattactacttaagttccttgaaatgaagtcagactaaacatttgtctcttatgtttgcgcatcggatattctcacaacattagagctgtctgttcaggtagtgcttgacttggatgagactttagtttctgcatatgaatcatctagtcttcctactattgtacgtacacaagctgttgaagcaggattacattgctttgatatggaatgcatatcatctgataaggatgctgaaggaaaacagaaggtgaatcatgtgactgttttcgagcgtcctggtttgcatgagttcttgcagaaaactagtgaatttgcagaccttatcctttttacagcaggtttagaaggttatgctagacctttagttgatcgaatagatgttcacaatagattcagacttcgtctctatcgcccatcaactgttaccacgngaatacagagaacatgtgaaagatctttctttgcgtgtcaaaagatttcggcag

SEQ ID NO: 15943 - DNA, 608 bp, Zea mays
  Clone ID: LIB3279-228-Q6-K6-A2
tgatggccaacaatcgagtgttttggctaactcttctgctgtaggatcctgatggtactttggaagtttatcaaaaccaaccattctctggataatatatatacatgtccacatgaggattagatgtagatactatatattaatacattaatgatgggaaacaaacttacccagaaacgcatgtccatataatgttttctattatttatgatttctcctttcggcccacgtgactctttattggcaagcagccgaacagccatgtcaaaacatcttagagtcatatggagtggtagcatcgcgttttctgtgtgcgcgtgcgtgaaagtagtcgtcatagcagcacgcaaacacacgtacacatggtaatgggagtcggtgcactgatccccattagcttggtaaagctccgccgaacagcctcgagggttcctctccacgcatatacaagtagcctggttcgaggccgtttacaagtccacgcaattcagtaatccaccatacatttctatatgttcaattgtactgctattgccactccacgtgtaatcaccagcctaaaagcttgtttacaactgaaaaaaaaaaaaaaaaaaaaaggcggccgc

SEQ ID NO: 15944 - DNA, 567 bp, Zea mays
  unsure (1)..(567): unsure at all n locations; Clone ID: LIB3279-228-Q6-K6-A3
gtaataaactgtgttttatctgaggctngagaagatttctatgaagctctatttcgaagatctaaggtaaaatttgatcaatttgttgagcaaggaagggttctgcacaactatgcttcaattttggagttacttttgcgcctaaggcaatgctgtgatcatccattccttgttatgagtcgtggggatacaaaagagtatgcagacctaaacaagcttgcaaagcgttttctgcgtggtggtaatggtgctgttaatggtgattcttgcatcccctctagagcttatatcgaacaggttgtccaagaattgcaaaaggatgaaggggagtgccctatttgtcttgaagcctttgaggatgcagtattaactccctgtgctcatcgtttatgccgagagtgtctcttatctagttggcggagtgcgacagcaggcctttgtcctgtctgtagaatgtcaatgagcaagcaggaccttataactgctcctactgataaccgctttcaaatcgatgtcggaaaaaatgggttgaatcttccagnatttctgctctcctgccggagttgg

SEQ ID NO: 15945 - DNA, 654 bp, Zea mays
  Clone ID: LIB3279-228-Q6-K6-A4
agcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaggagggcatccctccagaccagcagcggctcatctttgctgggaagcagcttgaggacgggcgcacgcttgccgactacaacatccagaaggagagcaccctccacttggtgctgcgcctcaggggaggcatgcagatcttcgtgaagaccctgaccggcaaaactatcaccctcgaggtggagtcttcagacaccatcgacaacgtcaaggccaagatccaggacagggagggcattcccccagaccagcagcggctcatctttgct

SEQ ID NO: 15946 - DNA, 648 bp, Zea mays
  Clone ID: LIB3279-228-Q6-K6-A5
cggtcgcgtgggggatgggttctccgcaggcttgtagacgatagcaacgtcttcgagtggcaggtcaccatcatcggcccgcccgacaccctatatgacggaggctacttcaatgcaataatgaccttcccccagaactatcccaacagcccgccatcagtaagatttacttctgggatgtggcatccgaatgtttatccggatgggcgtgtttgcatttctattcttcatccacctggtgaagatcccagtggttatgagcttgcaagcgaacggtggacaccagtgcacacggttgaaagtatagttctgagcatcatttcaatgctctctagtccgaatgacgagtctccagcaaatattgaagctgccaaggattggagagagaagcgggatgagttcaagaagaaggttaggcaatgtgtccgcaggtctcaggaaatgctgtgaaggaggaacatgggggagttgaatgagtctgcaatcggtgtgctgcaattcacaaccaattatctcatgccatcattcttttgctttcccctgtatattttttcaaccggtgtcactcgtatagtggtgtttgggtctctttagacaaactcgggacggttgcttatcctaaaaatcaatgtactgcgtggcatgaaa

SEQ ID NO: 15947 - DNA, 587 bp, Zea mays
  Clone ID: LIB3279-228-Q6-K6-A6
acaaacctaataagaaacctccagaacatgcccttgattccacaaggcttgaggaacacaggaaatatctgctttctgaatgcaactttacaggcattgctttcatgctcgccttttgtccaccttttacaggatctgaggaaccgtagtatacctaagtttggctacccaactctgcgtgcatttgttgagttgatctctcaattcgatgtgcttgacgagtcagttaacaagaaaaatgagaaggctattactgttgctgcaaagccacttaatcctgccatgtttgatgatgttctcagaaactttacaccagatgtgccggctggaataactgctcggccaaggcaggaagatgctcaagagtttttaagttttgccatggatagagtgcatgatgaactgctgaagcttaatggtaatggtttgaattcaaaggaggtatgggttgtttcttctgctgatgatgcttgggagacagttggaagaaagaacaaatctgcaatagttagacacatagttttgttccctctgagctaagtgctatttttggagggcagctacagagcgttgtgaaagctgcaggt

SEQ ID NO: 15948 - DNA, 555 bp, Zea mays
  Clone ID: LIB3279-228-Q6-K6-A7
gcggggatggcaaagggcaggacgacgggcagacgacgacgaagaagaagccgccgccggccactggcagccggactccgccggatgggaccggcggcaacaagccgctggccgacggcgccagccgcggacgtcgttgagtccaagaccgacaacgccgccgccggcagctagctagctagcagctgactgtgactgcacgtacgtacgggtacggcgctatgtttttttgatccattcctatgcatgtgtgtcctagctccgtcggatggcagctgcaggacctgcgctgctctcccaaagtattcagtacccacactcctccccagcccacacggacggtgttactgttaaccagagcataggacatgctaatgatgctaagctgttcttttggcaagtgaaagctgctctgcatcagtttatccatcaccatacctagattcaaacaaaacaatgttttagatgattatatagatgaaccgctggacacgatctaagacaaacaaatttatattctcataaaaaatcatgatacattatggtcgcggtcct

SEQ ID NO: 15949 - DNA, 191 bp, Zea mays
  Clone ID: LIB3279-228-Q6-K6-A8
ggtcatttaagttgttggagctgcgacgggggcggctggaccttgggccgggccgggcgtgccgtctgtcggcctgccgcggccgtctcggctgttgttgcgggcgtgcgctcgctggtcgccgctgcggcggtgcgcgcgtgccggtgccggcgcgtctcttccctgcgacttctctggggggggggggg

SEQ ID NO: 15950 - DNA, 228 bp, Zea mays
  unsure (1)..(228): unsure at all n locations; Clone ID: LIB3279-228-Q6-K6-A9
ccccgcgtccggnaaactatggaatcgcctagtctcccatagtagagcttagattgtcagttgagtatatacacatctgtgttgctatttaggatgctactagggtgttgtattccctggcagcttctttctcggttgtcgtcagatcgccttctctcctaatgtgagcggagcagatgaataaatatcctgtgtgtggcaaatgttggttagcagttcaattagccc

SEQ ID NO: 15951 - DNA, 231 bp, Zea mays
  Clone ID: LIB3279-228-Q6-K6-B10
ctagcctcaatctccaatgattggatctctgctacagtgctcttactactgccctagcgcaaatcttgatgtgtccgttctagctactactagtatctaccttggttatgttggatcatgcatgtgattgggttctgctagtactatggtttctgttctacccagtagatggctacttcactgtgttggatcagtcacattacatgatttctgataataatgatgcccttc

SEQ ID NO: 15952 - DNA, 517 bp, Zea mays
  Clone ID: LIB3279-228-Q6-K6-B11
cggacgcgtgggcggcggccctggcggcgtttcgcggcggcgcgcggacgcggctccgtggcggcgggcgggtgcggttgggcacgcgctgccccgccacgcggccccagtggcgcggttgcaggcctaggcacgggcgccccctggtgcgcgagcgcacggcctcaacggcgtgcgggcgcgcggcccccggctcacaggcgtggcctccagcgacggtccggcctcgtcggtggcgcggggcgtggccccgacgcgcgttggcgtattccctgccggcgcgggccacagctcctccgcgagagcgcaggcagccaggtgtagcctcggaatgggcttggcaccggcacgggcgcgcagctccggccacggatgccctccggccaaatgcggcgcggctactcggggcgtgggcacagtccctgtagggccctctccggtcagacgtgtccctggcgcgtggctcctcccaacgtgggttcagacatgccggtgcccggagcgggcagtcggacac

SEQ ID NO: 15953 - DNA, 590 bp, Zea mays
  unsure (1)..(590): unsure at all n locations; Clone ID: LIB3279-228-Q6-K6-B12
cgccngaacagcacatcgctctctcgatctcagccatggcggaggtggagcagccccaggacgcggtgaagctcttcaaccgctggaccttcgacgatgtccaggtgaacgatatctcgctgaacgactacctggctgtgactgcggcgaagcacgcgacattcctgccgcactccgcggggcgctactccaagaagcggttccgcaaggcgcagtgcgccatcgtcgagcgcctcaccaactcgctcatgatgcacgggcgcaacaacggcaagaaggtcatggccgtccgcatcatgaagcacaccctggagatcatccacctgctcactgacgccaatcccatccaggtggtcgtggacgccattatcaacagtggaccacgtgaggatgccacccgtattggttcagctggtgttgtgagaaggcaggctgtggatatctcacccctgagaagggtgaaccaggccatctacctcctcaccactggtgccagggagagcgctttcaggaacatcaaaaccattgctgagtgccttgcagatgagttgatcaacgctgccaagggctctttcaacagctacgccatc

SEQ ID NO: 15954 - DNA, 617 bp, Zea mays
  unsure (1)..(617): unsure at all n locations; Clone ID: LIB3279-228-Q6-K6-B2
ctccactccccccttcacanatccgttcctccagctagggttagcgttcctctgcagcgatggcgatcaagcggaccaaggcggagaagaagatcgcgtacgacaagaagctgtgcagcctgctcgatgagtacaccaaggtgctcatcgccctcgccgacaacgtcggttccaagcagctccaggacatccgccggggcctcaggggcgactcggtggtgctcatggggaagaacacgctcatcaggcgctgcatcaaggtgtacgccgagaagaccggtaaccacacctttgacccgctcatggacctcctggtcggcaacgtaggcctcatcttcaccaagggagacctcaaggaggtgcgcgaggaggtcgccaagtacaaggtgggggctccggctcgtgttggtctggttgctccagttgatgttgttgtgccccctggcaacactggtctggatccgtcccagacctctttcttccaggtgcttaacatccccaccaagattaacaagggtaccgtggaaattatcacccctgtggagctgatcaagaagggtgaaaaggtgggctcgtccgagtctgccctgctcgccaagctgggtatccgccccttc

SEQ ID NO: 15955 - DNA, 627 bp, Zea mays
  unsure (1)..(627): unsure at all n locations; Clone ID: LIB3279-228-Q6-K6-B3
cgctcttcgtctaccagccggcaccaagaacactccgccgtcggtcaagctcgtccactcgccccccgacttcaccttcttcgaccacgaggtcgcgttgctgcgccgccgcgactaggacatgttcttcatcgccgtgctccgcagggccttcgttgagcgggagtacaccgacgggcactttcatctccacctgtacagctccaagacaaagacatggagcaccaagctgatgcgccttgattcgccgccggattttgagttccattctcgcaacaaggggatcaccatcggaggggagcatggctctgttggttgggtcgaccttaggcgcggcattctcatatgtgaccttctcctccttgacagcaaccagagccttcgctacgtcccgctgccttcgccgctgtcgcccgagccactacagcgttatccgttgtctgttcggaacatcgttgtcctccaaggttacatcaagaatttcgagatgcacaataatgtcagaccgagctcatacactggaagctccccgatattagaaggttggattgctgcaacanaaaagataaaaatttcaagcattgggtctggtagtaactgggaggaggactgcactatcagatgctc

SEQ ID NO: 15956 - DNA, 642 bp, Zea mays
  unsure (1)..(642): unsure at all n locations; Clone ID: LIB3279-228-Q6-K6-B4
ggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctacggaggcggtggcggctacggcggtcggcgcgagggtggtggtggcggctaccgcggcggcggcggcggctggagggactgatgtgtgggcccatcctggcttcggccgagttatcttatctatctatagtatcgngttaccgntcgcttctgtcaccgngttagtgtccgttct

SEQ ID NO: 15957 - DNA, 635 bp, Zea mays
  unsure (1)..(635): unsure at all n locations; Clone ID: LIB3279-228-Q6-K6-B5
cagttgtctccagtttccatgcagagcagaaaagacagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagatgatagctgacggcttctctgtcactcttggnttcgtggca

SEQ ID NO: 15958 - DNA, 304 bp, Zea mays
  Clone ID: LIB3279-228-Q6-K6-B6
gggcaaagaaccccgaaggtgaggctggtgacggacagtaatcttgggagagcgcatattgttcgagcccattgttttagatgctctatgctgtcgaagctgaagctgtgccgtgctattattgtagctgatttcctgttccctcacttctttttttatattagtaggctggtagtgttcgaattagttccccattgctttgtgttgccgctagttggcattaagtccgtgtggactggtattattcactggatttgagaagcatgtcagtggttgctctagcgttttattgagttttgaagtc

SEQ ID NO: 15959 - DNA, 635 bp, Zea mays
  unsure (1)..(635): unsure at all n locations; Clone ID: LIB3279-228-Q6-K6-B7
ngaagctggtacttatgatgagaagaactgtttggtgtgactactcttgatgttgttcgtgctaaaacgttttatgctggaaaggctggcgtgccagttactgaggtgaatgttcctgttgtcgggggccatgcgggtattactattctgccactcttctcacaggccactcctgcaagcaattcgttgtcccaagaagacattgaggctctcaccaagaggacacaagatggtgggacagaggttgttgaagcaaaggctggaaagggctctgcaacattgtccatggcatatgctggtgctgtttttgcagatgcatgcttgaagggtctgaatggagttccggacattgtagagtgctcttttgtgcaatcaactgtgacagagttgccgttctttgcctccaaggttcggctcggcaagaatggagtggaggaagtgcttggtctgggtgagctcaacgacttcgagaagaagggctggaaagcctcaaggtcgagctcaagtcttccattgacaagggtatcaagttcgcccacgggagctaggcaactcgcccggcttctaacagttgatatcccttgcaaaattttttttttgactgccttttcccccccccccgttatggttggcgc

SEQ ID NO: 15960 - DNA, 544 bp, Zea mays
  Clone ID: LIB3279-228-Q6-K6-B8
aagatcgcctgctacgtcacggtcaggggcgacaaggccatgcagctgcttgagagcggcctcaaggtcaaggagtacgagctgctcaggaggaacttcagcgacaccggctgcttcgggttcggcatccaggagcacatcgaccttggtatcaagtatgatccatcaacaggcatctatgggatggacttctacgtcgtgctcgagcgtgctggctaccgcgtcgcgcgccgcaggaggtgcaagtcccgtgttgggattcagcatagggtgaccaaggaggactccatgaagtggttccaggtcaagtatgaaggtgtcatcctcaacaaggctcaggccagcacgatttaaacctcacctgtgggggcaaaacagctctcgcttcatctccatgtgaacgcaagatcaccttccaaggtttttgtttgagttgtatcctctggcccgacttttagtctactagcagagctataatcactatatgaattattttttgtgcccttaccatactctgctgttgcttgagaatatgttattagtc

SEQ ID NO: 15961 - DNA, 620 bp, Zea mays
  unsure (1)..(620): unsure at all n locations; Clone ID: LIB3279-228-Q6-K6-B9
ngaatttgcatgtcctaggcctgttaataagtggcttgctaacatttcaaagctgtcgacctcactgaagggtgtcaatctaacaaacaaaacccagcgtcaactatatgctggtcctaagtttgtggatcctgtgaagagcaacagcaatgacagcggctctcagcattgtaactggggaagtgcaaacgacatgctcccttcaagtgtgagcttcgtcaagctggctgacatgaaacctgagacgtggtgcctgttcctcgagaagttccaggagctccttcctgagacattccgctcacgcaagtgcagtgtcaaagagcaaagggcgaagcagaggcttggcacttcttgccagttttgagttggcacaggagtagagaggtgagcacctgctcggccgttgctgtggctttcatgcaggtgttgagctctgcagttatcgaataaagccatttttcacaggattgtgatttgcaacaggatttgagtgagtgggggcctgaacctgatgtccatgctgatatgatggcctcgctttgtaaatacattttccccctttttcttagctaggctctgctagacatgagttgcttgaaagaagtgggattcaatgtctg

SEQ ID NO: 15962 - DNA, 649 bp, Zea mays
  Clone ID: LIB3279-228-Q6-K6-C1
cggacgcgtgggggacgggacacctagggttcggataccggcaccggctcaactgacgacggactatcgccagtggcgatcaccctccctgtcccctgaccgcggcgtcccctgctcgcgccgcaccggtggcgacaaggcaccccttgcctgctcccctagacgcgagcgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgtttgactgtgtctatctatttaagcatggtgatcctgaaccgtacattggaaaaatagtgaagatctgggagaaagataatgataaaaaagtaaaaattctttggtttttccaccctgatgaggttcagaactatttaagtggccctgtgatgggaaaggagatttttcttgcctgtggtgaaggtgctgggcttgcagatatcaacccgctggaagctgtcgctggaaaatgcactgttatatgtacttcaaaggataagaggaatcgtcaaccatcccctcagaaactacaaattgctgattatatcttctatagggtctttgatgtta

SEQ ID NO: 15963 - DNA, 605 bp, Zea mays
  unsure (1)..(605): unsure at all n locations; Clone ID: LIB3279-228-Q6-K6-C10
caagctggcattgcttttccgactggatgctccttgaattgggttgcagctcactggactccaaatgcgggcgacaaaactgtgctacaatatgatgatgtgatgaagcttgattttggaacacatatagatggttacattgttgattgtgcatttactgttgcattcaatcctatgtttgatccattgcttcaagcaacgagagatgccacaaataccggaatcaaggaagctgggatagatgcacggcttggtgatgtcggtgctgcaatccaagaagttatggaatcctatgaggttgaaatcaatgggaaagttttccaagttaaaagtgttcggaacctcaatggacacagcatcgggccatatcaaatccatgctgggaaatcagttccaatagtgaaaggtggagagcaaacaaaaatggaggaaggggagttttatgccattgaaacttttggatctacgggaaagggatttgtcagggaggacttggaatgcagtcattacatgaagaactttgatgtcggacatgtgcctttaaggttagcaaaggccaagcaactgcttgngaccatcaaccacaacttcggaacgctcgcctt

SEQ ID NO: 15964 - DNA, 636 bp, Zea mays
  Clone ID: LIB3279-228-Q6-K6-C11
cttctcccctcctctgcccccatctcgcttctcgcacacggcagccggattccgaagcgcgccccctcggccccagccaaaagcatcgcagtttctaatcgtttggagagcacacaagaatgtcgttcgtgcagctctctggtgctggagtcgctgcagtggccttcacgaacaagagcctagtctctcggcacgcagcgctacgggtctgctcgtcgaggcgctcgatccgtagcctggtcgttaaggctgcaactgtcgtcaccccaaagtacacttcactgaagcctctgggagatagggtgcttgtgaagcttggtgccgcagaggagaagacagttggtggcattttgcttccatctactgcccagactaaaccacaaggaggtgaggttgttgctgttggagcaggaaggaccatcggggacaagaaaatagctgtggatatagagactggagcacaagtagtatactcaaagtatgctgggactgaggttgaattcaatgactcaaagcatcttattctcaaagaagacgatatcattggtattcttgagacagatgatgtgaaggacatgaagcctctcatgaaccgtgttctcatcaagttgcagaagccgaaacaaaatcctgggg

SEQ ID NO: 15965 - DNA, 632 bp, Zea mays
  Clone ID: LIB3279-228-Q6-K6-C12
ggacctcctcaacagagcgagctcctcctcaattccaacccggtgcacaagaaagtgcccgtgctcatccacgccggcaagccggtcgccgagtcgcaggccatcgttcagtacctcgacgaggctttccccggcggcacgtgcccgtcggtcctcccagccgacccctacgcacgcgccaccgcccgcttctgggccgccttcgtcgacgacaaggtcgggtctccatggcacacggtcctgttcgcgcgggagcacgggaagaaggcggacgcggcgtcgcggatcgtcgcggcgctggagacgctggagggcgcgttcaaggactgctccggcgggagggactacttcggcggcggcgccatcggcttcgtggacgtggtcctcggcagctacctgggctggttcaaggtgttcgagaagatggtcggcgtcagggtcctggacgtggcgaggacgccgctcctcgccgcgtggggggagcgtttcgcggcggcggaagcggccaaggacgtcctgccggatgacgttgataaggtgctcgagttccttcagaagttcctggactagactaggtgcgcgccaccatgtgctcggtgctctggtgtccaccccgatagttgtttgctttg

SEQ ID NO: 15966 - DNA, 648 bp, Zea mays
  unsure (1)..(648): unsure at all n locations; Clone ID: LIB3279-228-Q6-K6-C2
tgattgtgtctttcttcagaatctcagctgttcctcatgtggagaacctccagaggctcacatgtattcctacactcaccgcaacgagaatctgattgttcttgtgaggcacttgctgcctaaatattgtttacctggtgaatcagaaggaaagatttggatgtggactagatgcttaaggtgtgaacgtgaaagtggggtccccagatcatcacgaagggtgataatgtcagctgaagcacactacctttcatttgggaagttccttgaacttagtttttcaagccactcaaccgctagaaggctgccaatatgcgggcattcactcaatacggattgtctgcgctttttttgggttgggctccaaagttgcaatgttccagtattcctcagtcgaaatttacaatgcctgcaaaccacagcctactcttgagattcacaaccccgatatgcacaaagatgccccaaggttgctgccctcgtgtttcgtgctctgattgttgagtcttcaatgagagctgattccagttatatagagctacaatgcttccgagagaagggaaaccggcaaaggggaaaagagacgaatagaagggcattggtgccctctcacacacagccaagttacatncacatgccacaaggctg

SEQ ID NO: 15967 - DNA, 384 bp, Zea mays
  Clone ID: LIB3279-228-Q6-K6-C4
ggaaaagatcgtcagaagctggataaggatgtgcaaggcaagcgtgacaaaacacagctggttgaagattctcctactgatgatgagcttgacgactacccatttttggacaacagtcctgttaagtttgagctgaaagatgagtcagtgattccagatattggagcaatctgaagtgatagtgtttgtgcgattgttctgtagcaatctatgtagtacgatgtttagtacatgttgtttgttctgtagcaaactatgtagtttgagctgaaagatgagtcagtgcctcatcgggtacttttgagtaccgtagcggttgtcaagtttcatgctctcctgaaaaatccttcgcaactcgcaagtgaaactctggtttatgccctg

SEQ ID NO: 15968 - DNA, 624 bp, Zea mays
  Clone ID: LIB3279-228-Q6-K6-C5
aggagagtgcgagctggtgagatggatcggttggaggagcggaacattaagaagggggagagggagatggaggaggcgcgcaaggaagaggagcggaaggaggaggcgggggacaggaatacccaggagccgcagcaaggtcaaggcctcagcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaaggcagtgctgccactgcttttaatcctccaatgagcacttctgtagcagctggacaagctcaggttgttgctgaccctagctcaataagcaagcttcaggctgatctccccattgccaggaggcactctctccagcgcttccttgaaaaacgtcgtgacggggtcgtgagcaaagctccgtacagccccgccaagtcgttcgatggcatggagtcagcgggaatggagatgactgcggacggcaagcagggcgcaaggcccagtatcttgaaagttggggag

SEQ ID NO: 15969 - DNA, 370 bp, Zea mays
  Clone ID: LIB3279-228-Q6-K6-C6
cccacgcgtccggtgagagtctgtacagatactgagcattgcaatgggcgagcagcacgtgtgtgctgatccttaccacattctgaactccacgtgtttgatggccggggagaacatagaagaatctccgtgggagaggtactgatgagagagagcgactattttgtgttcataatattcattaccttttttttagcttttttcggtcgttgcccagttcgtagtttttgccttacattggacttcgctccgattttttttctctgcttttccttcatagactggtgtaagctgtaaccgaacactgtcaaatgcaaatcatcttagggccccttcggttattactgaatggaggcatggaataatttct

SEQ ID NO: 15970 - DNA, 397 bp, Zea mays
  Clone ID: LIB3279-228-Q6-K6-C7
ccccgcgtccggcgccacctcctatctcgtctccttcgtccccacgagcgagtaagctagtcttgctagtatcaacccgacgacatgttggtctaccaagatctgttctactgggttgaaggaaattgtgaacttaaaaacggcattcttggaggtcaatgacaagtgggtcgtccaagtacatgttgatgtgaatattggcacacaacatacatattgttgactttgttgacaccttacgccttcagtagcaaccccatttgatgagaaatcatttgtgtcttacattaaaaaatacatcaaaaaacatattcgtttattcttatcaaactcaataccattcaattctttgttggtgatagcatgaatgacgatatgactgtggagttctcctatt

SEQ ID NO: 15971 - DNA, 408 bp, Zea mays
  Clone ID: LIB3279-228-Q6-K6-C8
gggcacctaatgttaagcatgctaattttgcagggtatttggctctgtgaacatcgagattatgctactcctcgacagattgtgatcacgctgaatgggatctagcctaaggtgatctatgttaagagctggaaatgcaatgcagcgacttcgacatgtttaaatcagatgcactgaaactgaaactgtctttggcccagttgtgataggcgttccagtggagaatgttatttgtaatatgatgctagcatgaggggaacaaaatctcttaacgagcttcttctcatgttgagcttgtttagttatctttggtggtttaaagaaatggtttataagttgttagtgtcgtttggttcacgaaatgtaacgtaaatggtaatgataatgattcacactctgattaacact

SEQ ID NO: 15972 - DNA, 627 bp, Zea mays
  unsure (1)..(627): unsure at all n locations; Clone ID: LIB3279-228-Q6-K6-C9
cctccccccaccccgctgtgctcatccatcgaccgcgacgagcccccgcccgccgattctactacgtttatttttttatttcatttgatttgattgcaaagcaccgcagcaggaggaggaggggaagggagggatctttggaccgtcgttcggctggatggtggaggtggctcgttgatttgagggcaccgggtttcttggacctgcgtaggtaaaaaacaccagccccatttccctctcggccggcggatggacgcgagggaggtgtgaagcctggtcgctaactgatgctcgtggagagattcggaggagaggagcgcgccgtgcggaggcggtggaggaggaagcgccgacgatttggacagcgcagcgacggaaggggagcagcaggcggacgaggagcgagccgccaggaggacgacggccgtcgccgccgccgccgccatgggcgagtcgctgctcaccgcgctctccatggacaccgncacggnccaccacccgcaccagggcccctccaccttcctctccatggacaccgcctcccacgacgacttcgacctcttcctccagccacaggggcccttccgccgctgcctacatgccgcggcggtcgccccccctgacatc

SEQ ID NO: 15973 - DNA, 624 bp, Zea mays
  unsure (1)..(624): unsure at all n locations; Clone ID: LIB3279-228-Q6-K6-D1
ctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggttatggtggcgggcgccgtgacggcggttatggcggcggtggcggctacggcggtcggcgcgagggtggtggcggcggctacggaggcggtggcggctacggcggtcggcgcgagggtggtggtggcggctacggcggcggcggcggcggctggagggactgatgtgtgggcccatcctggcttcggccgagttatcttatctatctatagtatcgngttaccgttcgcttctgtcaccgtgtt

SEQ ID NO: 15974 - DNA, 670 bp, Zea mays
  unsure (1)..(670): unsure at all n locations; Clone ID: LIB3279-228-Q6-K6-D10
cccagcgtccgcgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtnagctgcagatgggacgaatgtgcttgtatgtgtatgtgtcctgctgc

SEQ ID NO: 15975 - DNA, 686 bp, Zea mays
  unsure (1)..(686): unsure at all n locations; Clone ID: LIB3279-228-Q6-K6-D11
attggcgattccatttctaccccgagacctccagccgtccgcccctgaaccctcagccttctccgtcccgcctcggcactcgacggccgccggcacacaccgcgcagtctcgagacaggaaccggaggaacgaggatggaggatgactcgccgctgacgaagacgatgaagggtgcggtgacaggactcgccgcggggaccatctggggcaccgtcgtcgccacctggtacgacgtgccccgtgtggagcgccacgtcgcgctccctggccttatccggacgctcaagatgtgcggcacctacggggccaccttcgccaccatcgggggcctctacatcggcgtcgagcagctcgtgcagagccagcgcaagaagcgcgacttcgtcaacggggccgtcggcgcgttcgttgccggagcctctgtctgcggctacagaggaaagagtattcagtcagccctcatcggaggctcctgtctggctttcacatctgctgtgctggacattggcggcaatacgaccagagttgacaacggcaaagagtactatgcctacacaactgagaagaagcctgcanattgattccaagtctgcacttctagcaaacaatcttgcacgccatcaactcagtgaatttgaagctgatgtgcagttttaatgtctgttttgctgatgcaattagttct

SEQ ID NO: 15976 - DNA, 505 bp, Zea mays
  unsure (1)..(505): unsure at all n locations; Clone ID: LIB3279-228-Q6-K6-D12
attctctcggtctctaccaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccgctcccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttcgtcaacggctgtgacggctccgttcttctggacgacaagccgttcttcatcggcgagaagacggctgtgcccaacgccaactcaatcangggcttcgaggtcattgacgccatca

SEQ ID NO: 15977 - DNA, 657 bp, Zea mays
  unsure (1)..(657): unsure at all n locations; Clone ID: LIB3279-228-Q6-K6-D2
gtgtaaaacgaacaagnaaaaatgcagnnctccaagtctgcggcattgactcaacatacattgttgcagcactcaaaggagcattgcttgatgggcataaaaggaactgtgcggcgtagcacggatggccatgtcatccatgcgaatattgacacagatataataatagctgaagaaccaaccgatggttcaacaaagaagcctgaggacatgtacaggatcattgagcattttgcgcttggaaggaggcggctcgaactctttggagaggatcataacatccgcccggggtggcttacccttggaaaaaatctatcctactccaacttcaacaaagaggcatacattaggagttttgcagacaaggatgggaaagtatggcaaggaggcggtggccgaaaccctcccccagaggctccccacctcgttgtgacaacaccggagatcgagagcctgcggcctaagtcgcccccggcaaagaactaacagccgtcgtcaattttgttacgcgggctacaaatttttttttggggggtggggggggacagtagctntgacggctctttctgaagtccacatgaggccttatgaaccttctgtctacagaataaaggattntgcctgatgggccctgtctgttagcaattattagtgacg

SEQ ID NO: 15978 - DNA, 607 bp, Zea mays
  unsure (1)..(607): unsure at all n locations; Clone ID: LIB3279-228-Q6-K6-D3
atcacgnngccctcaaaaacgcagcagctntaaaaaccccaagcttaagaaaagcgtaccggtttcttatcaatttgagaatcctgatattataaaggagagggaagaggagcagaagatgatgaaagaaaagcagaagaaggagaaagccgaaagaaaaaaggaaagagtaagaggaagcatcgatcgccgagtgattcagatagcagcaatagtgctgcttcggtgttcgactctgactctgaatcatcgggctctgaatactcttccggaaccagttcaagttatagttcctcagactctgaagacaagaagcggcaacacagaaggaagcagaagaagagaaggcacaggagggacagcacatcatcatcatcttctgaatctgagtctgcgtcagacagtgattcggatgacaagaacagccggaggaagagtaaaaagaagggtggtaggcgctgaatctaatgagctgcacaaagcagtgtggatgttgaatatcatcattatatactttgtgttcaattcatgaataaatttttcgtcatcatcagaccatgtgctggggctttgccaatcccagaaacaaatgtagcatttgcttttc

SEQ ID NO: 15979 - DNA, 627 bp, Zea mays
  unsure (1)..(627): unsure at all n locations; Clone ID: LIB3279-228-Q6-K6-D4
cggacgcgtgggcccagcctcggccagccacctccccgtcgctctcacgctcttcgtgcccgccgcctcccctcttcccctccacctcactcctcccgtctgacgcacatggcctccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtggacaaggtttgtgaaattgtgaagaagcagcttgctcttcctgaccacactgaagtttgtggtgaatcgaaattctctgaacttggtgcggattcgctggacacggttgagattgtgatgggccttgaggaacacttcgacattagcgtggaggagtccagcgcgcagacaattgccaccgttgaagacgccgctgacctcattgacaagcttgttgctgtgaaggcataggccgcatctcttctatcattgtcttaccactctaggtttctatggtctgaagacttgtgattntctccgcactgctgttgctattcccgtgtcgtaataatacgagatgttttaagcggctga

SEQ ID NO: 15980 - DNA, 637 bp, Zea mays
  unsure (1)..(637): unsure at all n locations; Clone ID: LIB3279-228-Q6-K6-D5
gcgttcggccgacagctacgttctcaagctcaaggaagccacctgggttcctcacctgttccgtgtcagcgtcacgcagcatgaatacatgaacgagaagaggcagagaatcaccgtgaggggtgaagcaccggtcgacttcgcagctgagtccaagtacttgcttgaagagatcgcgaagctcaccgcttgctagaagacgcagtctttctggtggttcttgaaggactggcccccgatgtctccctcgcagtttttcttttgagctccagtaacttgattactgttctgtgtgttgctctcactgggttttagcacttctgtaaggtatatgtagatgctagattaccttggtgtcaaggaacagatgctatgataagccttgcaaaattgcagttccaattccgtgtatctgcaactttgagcaaataggaaaagattatgagtactgattgatgatgttaggtcgctgcagctaacaagtgtttggtttttatggactactgtttagtccctgtattttattctattttagtatttaaggggttgtgtttgtntgcgtcgactgnacgtgttgtgccgtgtccgatgagtctattattgaagcacagaattgagaattggaataagctttttt

SEQ ID NO: 15981 - DNA, 255 bp, Zea mays
  Clone ID: LIB3279-228-Q6-K6-D6
ggtgagaagggtataattttcgtcactattcttttacagtctatgttggatactgtacctactttactaaatagcaaaaagcaaacatatgaacaagggcggtgctacaactactgcgttgtgttggatgtaaagccttgatatattatcactttcccatgtagttgtggctataggcggcttcttttcagtgaacatattgtctgtttcagcgttcttgctggatggatagtaaatggctgtaccatttggttg

SEQ ID NO: 15982 - DNA, 668 bp, Zea mays
  unsure (1)..(668): unsure at all n locations; Clone ID: LIB3279-228-Q6-K6-D7
gcatctggtctcgtctctctccgatccctctcctctccctccccctagccactacccacttgagcgagccctaggccctagcaggcgaaagccatggcgtccttgggtgttcgtgccgccgccgccgctcgtcttccctccctccgtcctcgccgcgacggcagcagggtgctcaccggcttgagggtcgggacagggcactacggcgtgcggctcgcgctttcttcgtccacatcagcttctcccagagagttcaaggtcgctggccttcctgtcgatgacagcagtttgggcccgggggatgaatatgagtttggactctatactcctaagctgcttgcagttactggagatgattatgtgtctaacccccgcatgccagacgaggatgagttcgaccatttctaccgtgttgtcgccaagaagactgacatgctgctcagctgccaccttccaaagccgcttgcagtttctgaagaggagaaggccgtgcaggagaagttcaaggagatggcgaacgaatgcatcgacctcctggttgatgcgatgcgccgcatcccagcggagaaaagcgcccactgttctcggtgtttggtgagctngtacccgtatttgagtcagtgaggtggactgccgaggggggtgtgccaagtggtggatggcgctgc

SEQ ID NO: 15983 - DNA, 601 bp, Zea mays
  unsure (1)..(601): unsure at all n locations; Clone ID: LIB3279-228-Q6-K6-D8
cgacgacgagnaccttcttgtccgcatcgacatgtcggagtacatggagcagcactcggttgctcgcctcatcggagcaccacctggctacgtcggccatgaagagggtgggcagctgactgaacaagtgaggaggaggccgtacagcgtgatcctgttcgacgaggtcgagaaggcccatgtcgccgtgttcaacaccctgctccaggtcctcgacgacggcaggctgacggatgggcaaggcaggacggtggacttcaggaacaccgtgatcataatgacatcgaacctcggcgccgagcacctcctcgctgggatggtgggcaagaactccatgaaggtcgctcgcgatctggtcatgcaggaggtgaggaggcacttccgacccgagctgctgaaccgtctcgacgagatcgtgatcttcgatcctctgtcccacgagcagctgaggaaggtcgctcgccttcagatgaaggatgtggccgtccgtcttgccgaaggggcatcgctctggctgtgaccgacgccgcattggacatcatcttgtctctctcttacgatcccgntgtacggcgcgcggccaacaggaaggtggatcgag

SEQ ID NO: 15984 - DNA, 221 bp, Zea mays
  Clone ID: LIB3279-228-Q6-K6-D9
gttctcatcttctgctcgctggtgtcctctctctctcacccaaaactctagttgctcgtgggtgtcaactttttattatatgttgttatgtttgtgcaaaatcaactgaaatgtgaagtcaagtggtgatgctgtgaactgagtttagtgttgtccacttagtttgtatgatcactggaatactagttgtattcatctacggaatatggaattgtgtgctc

SEQ ID NO: 15985 - DNA, 634 bp, Zea mays
  Clone ID: LIB3279-228-Q6-K6-E1
cccagcgtccgccaaaccatctcgactcgtggggaagtttcgctctcgcggtggtcgacttcctagggttcgaggaacgtccgtccgtccgtccggggaaggtgcaggagggaggcggagatgatcgaggtggtgctcaacgaccgcctggggaagaaggtgcgggtcaagtgcaacgaggacgacaccatcagcgacctcaagaagctggtggcggcgcacacggggacgcgccccgagaagatccgcatccacaagtggtacaacatctacaaggaccacatcaccctcaaggactacgaggtccacgacggcatgtgcctcaagctctactacaactgagcctccgtccctctctgcctttcgtcaggtactaacagtagcagcgagtggtttcctctacaactcgaattccttttgattcagttcctgcgcgcctggccaccgggaactttaattggtcatatgatccaattcgagtatttgtagttatattggttatgttgatcgcatagtgctgaggctatttacgatcgtctagtgtgttgaagcacttaaatttacagttcagtgtagaatctcaattaaatcgttctgtgaaatgttctgcttggaaatatcaaaagatcttttt

SEQ ID NO: 15986 - DNA, 653 bp, Zea mays
  unsure (1)..(653): unsure at all n locations; Clone ID: LIB3279-228-Q6-K6-E10
cccatctcccagaacctcctcanacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaaatggataggaaatgccgtgtttcttaa

SEQ ID NO: 15987 - DNA, 609 bp, Zea mays
  Clone ID: LIB3279-228-Q6-K6-E11
ggctgcctgtgcgcgtttctctaccccgccggcctcctccctcgtgcccccgactccgccagccactggccccgccaggtacaatacccgagacagcggtgtgtacgaggacgagagggagaacaacggattcatcaccgccaggcgtcaggtcagagtgtgttaagaaaagatggtggcgaatggcgacgcacctgctagagggagtgcgacggtagctgcaagcctgcgcaggcgtaggaccacaagcgttgctgctgctggcagaggtggtgccagctcgatgctccagttctacaccgatgaggctgcgggccgcaaaatgtcaccaaacacttttctgatcatgagcattgggttcatagctgttgtcgctatgctccatgtttttgggaaactgtaccgcacctccaactaggttggtactaccataaccaagaaaacagaggccaccaagagaggagccttatagagccatttcaatggatagcaagtgactatcagagaggaaccttgtagagcgatttcaatggatagcaagtgactattcagattgggaagtgttattagaagtttatctatacaacttgcaatgttgagggctatgat

SEQ ID NO: 15988 - DNA, 625 bp, Zea mays
  unsure (1)..(625): unsure at all n locations; Clone ID: LIB3279-228-Q6-K6-E12
cccacgcgtccgcggacgcgtggggccgcgccggcgcgcagctgagccgccgaagcgaggaggcaatcgaggcggacgaagcgccgaaccaaattcgacgggggatcgagcaccagaggcgtagcgcaaaatgttcaagttcctcaaggaggtggtcgcgggatccggatcgggactcaaggacttcccctacaccatcggtgagccctacgcatcggcttggggctcatggaaacaccaccgcggtacctccaaggatgatgggtcgcctgtgtcaattttttctctatcagggagcaaccctcaggacagacacatggttgctggtcgcaatggtgttaagagattacgaacagtgcggcatccaaatatcttatcctttttacacagcactgaagcagaagctgcggatggacctgccatgaaatacacaatttatattgtaacagagcctgttatgccactttctgaaaagctcaaggaactgaatcttggtggtacacagaganatgagtactttgcatgggggcttcatcagatatccaaagctgtgagctttctcaataatgactgcaaacttgttcatggtaatgtatgcttgaccagtgtttgttgttacacaaac

SEQ ID NO: 15989 - DNA, 575 bp, Zea mays
  unsure (1)..(575): unsure at all n locations; Clone ID: LIB3279-228-Q6-K6-E2
ccccgcgtccgcggccgcgtgggcgcgcgtgtaattaacgtgtggcaggaatacagccgcacgtgaccatctatcacttcgaccttccccaggctctccaggatgaatacaacggcctgctcagtccgagaatcatcgatgattttaccgcttacgcagacgtgtgcttccggagcttcggcgacagggtgaagcactggatcacggtgaacgagcccaacatcgagcccatcggcggctacgaccaaggctacctcccgccgcgccgctgctcctacccgtttggactgggcgtcacctgcacccacggcaactccacgacggagccgtacgccgtcgcccaccacctcctgctcgcgcatgcgtcggctgtgtccctctacagacgcaagtaccagggcgagcaaggaggacggattggactgacgttgctggcctggtggtatgagccagcgacgcagaagcccgaggatgtagaagcagctgccagagcaaatgacttctcgcttggatggttcatgcatcccctggtgtacggngactatccgcccgtgatgaaaaggaacgtgggggca

SEQ ID NO: 15990 - DNA, 628 bp, Zea mays
  unsure (1)..(628): unsure at all n locations; Clone ID: LIB3279-228-Q6-K6-E3
agtaaggcttttccaggggtgtagctattctaatctcgtttctggtttcagctgtattccatgagatatgtattgcggtgccgtgccacattttcaaattctgggcattttctgggatcatgtttcagataccgttggtattcttgacaagatatctccatgctacgttcaagcatgtaatggtgggcaacatgatattttggttcttcagtatagtcggacagccgatgtgtgtccttctatactaccatgacgtcatgaacaggcaggcccaggcaagtagatagttcggcagagacatgtacttcaacatcgaccatcagaagcagactggagcgacgcggcaggaagcagcagtagcccctcacttgccattgtttaccatcagctagcagctggtcagcctgaaaatgcttctattccaggcggccgtgctgggatgcagcgtgtacattaccagcgatgcaacgtcaacggttaccaagcgcggataagcagtgctcgtggcatgtgaactctgtacacattgaagtctatatgtccgnggtgctgtgtgcataatgtcgtggtagatgtaatatgtacaatgtttgccacgactttaagagtcaaaatgaggctcacgtct

SEQ ID NO: 15991 - DNA, 488 bp, Zea mays
  Clone ID: LIB3279-228-Q6-K6-E4
atatgctagtattaggacatcatattataataagtattatttcaagaagaccatccgattggtgcggctacgtcaaacgttcgcgccatgactgcaacattctagtggccaatgttgttgacttcaggcaaatcacgatggagatgctctctcgactagagctcgggacgacagggctcaagaccctcacgcgcgaggtgatgggcttgctcatcgacaagcccaagcatgtgacgctcagcaggtggacaaaacgttcttttggcccccacaggtctagtacgtcgtcgttgttgatgtctatgggttctacaaggttggttttctgttgttcacgacggagcgcacgcacaaccgatggaaggtcgccgccgtctatttgcattaagttgctgttagagcatctccaatataagttctaaatggagttgtattttgaattttagtactttaacaataatatttctttaatagtgatgctattttac

SEQ ID NO: 15992 - DNA, 619 bp, Zea mays
  unsure (1)..(619): unsure at all n locations; Clone ID: LIB3279-228-Q6-K6-E5
ataagctcagnaatcagatcagaagccgccgaggggaggcgccgacgccgagtttttgctccatcccgcatccaccgccagaatgtttctcacgaggacggagtacgaccgcggggttaacaccttctcgccggaggggcggctgttccaggtcgagtacgccatcgaggccatcaagttgggatccactgcgatcgggttgaaaacaaaggatggtgttgtccttgctgttgagaaacgtgtgacctcgccactgctggaaccaagcagtgtggaaaaaatatggaaattgatgagcacataggctgtgccatgagtgggcttattgctgatgctagaacactagtcgagcatgctcgtgttgaaactcagaatcataggttctcatacggggagccaatgaccgtagaatcttcgacacaagctatctgtgacttagctctgcgctttggcgaaggtgacgaagagtcaatgtcacggccatttggagtctctctcctaattgctggacacgatgagaacggacctagcctgtactacaccgacccatctggcactttttggcaatgcaacgcgaaggcaattggatctggctctgaaggagctgatagctccttgc

SEQ ID NO: 15993 - DNA, 541 bp, Zea mays
  unsure (1)..(541): unsure at all n locations; Clone ID: LIB3279-228-Q6-K6-E6
gcggaccgtggggagatgacaacgaaccaanaagccggaattgttggcaaatatggaaccaggtatggtgctagcttgcgtaagcaaatcaagaagatggaggtatctcagcactccaagtatttctgtgagttctgtgggaagtttgctgtgaagaggaaagcggttgggatttggggatgcaaggactgtgggaaggtcaaggccggtggtgcttacaccatgaacactgctagtgcggtcactgtcaggagcacgatccgtcgcttgagggagcagactgaagcatgatcggtcgcttgtcaggcatactggggtccactatattggctgtgtagccgagacagtactccagcatttttgggttatgctctaggatctctaaaggttgggtgctaagatttctacttgtttaccgttgtgaatttcacaagtgatatctgatcctattactatcatgatgacgtcaaatttgcttctggtttctaccctttggtttgcaaatccctttttctttgaaaatttacttataatgcttacc

SEQ ID NO: 15994 - DNA, 580 bp, Zea mays
  Clone ID: LIB3279-228-Q6-K6-E7
catctccctctccgaaacaagtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaagtcgtggcga

SEQ ID NO: 15995 - DNA, 605 bp, Zea mays
  Clone ID: LIB3279-228-Q6-K6-E8
gctagttggtgctccaggcgggggatcaagtccacatgtagtacaaaatgccgatatccctgttaagcaaaccactagctcttcctcacgtgagcagtcagacgatgatgacatggaaggagatgctgagactactggaaatggaaaccctgttcaacacagattacagagaaggaagcaatccaaccgagaatcagccaggcgttcaagaagcagaaaggcagcgcacttgaatgaactggaggcacaggtagcacagataagaggtgagaactcttcgctgctaaggcgacttgctgacgttaatcagaagttcaatgaggctgctgttgacaatagggtgcttaaggcagatgttgaaaccttaagagcaaaggtgaagatggcagaggactcattgaagcgggtaactggcatgaacacattgttccctgccgtgtctgatatgtcgtccctcagcatgccattcaatggctccccatccgactccgcctctgatgccgccgtacccatccaagatgacctgaacagttacttcgccattccaagcgagatcggaggcagcgacggttacatgccagatatagcttcctcgggtcaagaga

SEQ ID NO: 15996 - DNA, 645 bp, Zea mays
  unsure (1)..(645): unsure at all n locations; Clone ID: LIB3279-228-Q6-K6-E9
cggtcgcgtgggcggacgcgtgggcggacgcgtgggcggacgcgtgggcggcccctttggctggagttgcagattggagcattggtggattacttcaacatgcaatgtttatgactttaattccacaacatcctgtgctccatgaaaacaatgaaccagattatgaagcagaagtgcttcatgaagacaatgaaccagattatgaagcagaagtgctccatgaagacaatgaaccagattatgaagcagaagttgaagaagaagtgctccatgatgacaatgaaccagattatgaagcagaaggggatgccacattctgtaaaagggattattctcatgcattggatctctatactatggcaatggaaattgatcctgataattcaaccttgtatgcaaagaggagcctttgctttctgtacacaggcaatgaaggaaaggctttggaggatgctactacctacagagatatgcaaccagctcttgctctggtcaaggagtattgcatgacatgcgaagcactcttgcctggcttgaactcggattttttaagcaaaccaactgacgaagcgttcgggggaaggacaatccgtgaagtaaggttattagtgtacaggnaagaaagaagttgttactgcacaggaa

SEQ ID NO: 15997 - DNA, 626 bp, Zea mays
  Clone ID: LIB3279-228-Q6-K6-F1
ccggtaagacccaacaccaccaccaccactagaagccagcgacgatcgagccgcgcgccggtggacgcgcacatacacgcggtagcttccttctcaagcctagctagccccatcctgcgcgcaggcggcggcagcgagaattgacgtgcgacgacgagcttgtgcttgctagctagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcgcccgcgccccccggcccatctgttctctccaccggctggccgccgggagccgagctcaattagctagggtatatct

SEQ ID NO: 15998 - DNA, 638 bp, Zea mays
  Clone ID: LIB3279-228-Q6-K6-F10
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctc

SEQ ID NO: 15999 - DNA, 625 bp, Zea mays
  unsure (1)..(625): unsure at all n locations; Clone ID: LIB3279-228-Q6-K6-F11
gcggtccgcaactcctctaaacccttcctctccctccggcgccggcgccgacatggccgtccactacctcctccgccgcggggtcgccggtggctcactgctccaccctatccgcggtctcttcgtcgcctccaaggagcttgggaggcgtccgttgggctctgcggcggcgggagacgcagcggccgagctgaggggcgcgcgggaggacgtcaggcagctgctcaaggccacctcctgccatcccatcctggttcgattaggttggcatgatgctggtacatatgacaagaacattaccgagtggcccaagtgtggtggagctaatggtagcttgagatttgaagtcgagttgaagcatggggccaatgctggtcttgtgaatgctctgaagctgatccaacctatcaaggacaagttttcaggtgttacctatgcagatctgtttcagcttgccagcgccacagccattgaggaagcaggtggccccaaaattcctatgatctatggaaggggttgatgttattgcccccgaacaatgcccaccagaggggagggcttcctgctgctggcccaccttcacccgcggaacatntgcgttgaagtattctacagaatgggcctg

SEQ ID NO: 16000 - DNA, 83 bp, Zea mays
  Clone ID: LIB3279-228-Q6-K6-F12
cgtccgaatcccggtcgaccccgcgtccgctagttctagatcgctcgcgatctagaacgcagggcccccccccccccccaaga

SEQ ID NO: 16001 - DNA, 376 bp, Zea mays
  Clone ID: LIB3279-228-Q6-K6-F2
ggggtcagctgaccccaaataagggctggctccgcccctggaccaaggattcagaagtcatcggtaataaaaaggacgtctgtagccaaaagttcaagacgcatctgcaggagaaagaaaagaaagaaaaagaaattatcatccagagaatacgtgagaaataagcaggaatacataaccaagatatttgtcaggtcatcatgcaaatccttggagttggcggccacaaaataggagtttgttgtaatcttttcctattatttagaataagttagttttatatccaattagagacgggatatataagcactattgtaagctgcggagacgagagatcaacagttatcattttctttaatctactacatattccttt

SEQ ID NO: 16002 - DNA, 362 bp, Zea mays
  Clone ID: LIB3279-228-Q6-K6-F3
gtgcgcacctctatcgcgcgcgtgctcacagtgatctcgcagaagcagaagtcggcgttgcgggaggcgtacaagaagaagaacctgctccccctcgacctccgccctaagaagacccgtgccatccgccgccgtctgaccaagcaccagctttctctgaagacggagagggaaaagaagcgtgagaagtacttccccatgaggaagtatgctatcaaggcataggtcagaactgtgagatgctgtgctttgcatatcatcggctgtgttttaatttttggtttgtatggacatttgttgtggctcggaagtacgatgtattcctctgttgccttataaatggctagattggtttgactggc

SEQ ID NO: 16003 - DNA, 633 bp, Zea mays
  unsure (1)..(633): unsure at all n locations; Clone ID: LIB3279-228-Q6-K6-F5
ggcggacaggttttcatacaatcagatgtactggaagtagcggtagacatgagggaaaggtttgatgggtactctggtattttggcacgtgttaattatgtcgatcaagatcttcagtgtgacaatgaaggatggcttctggacaacccaatgggaatccggacagagcgagaaatccatgcagagcttgaaggagcaacgatatacaggagggtgtaccaaaaggttagagatgcttctttctagctgtttatcagctacagaagttgtccgaggagtaaggtttccaagaatgttcattgcatgtatttcattaagagaagttgggaaaaaacaaagcatccaagtacaaagcctggcgaaccaaaacgaagagaaggccaagcagtaacacacctgatgtcttcctgcttgaaccatgccacaagttgcctttactacatcaagctgcattacatttctgacagtgcgcttgtgcacatctaatctttttttttcacctgatgcaatgagtcagattagccaatgcttttgatgaagatgacaactgncaaaagtgttcctttgttggtcaaattgtacttatgggtgtttagcatcaggtgctgtcttcgttctgtccataattcagtc

SEQ ID NO: 16004 - DNA, 633 bp, Zea mays
  unsure (1)..(633): unsure at all n locations; Clone ID: LIB3279-228-Q6-K6-F6
ccccgcgtccgccccgcgtccgccccgcgtccgctctgactaacaggtctactatacctggaaattctaccatgggtgtgaggccagcttatggtcatgttaatggagggcagatacatggtcttaaaaaccttggttgttcttcggtacctgatgctcagccatcaggttgcccatctgagtctgttattagtaggaggaggtttgagttcatgagaaagagggcctttgaccaggaaagctcttccagatcagtgaacttaagcttaggtcattcaactcctacagatattcgcagaatcagaatgaatgaacaatcactttgtcaacaaataccacgaagcagcagcagaagccatcaggaatcggcaggttcagttaggacaagacgaccttctcctcatgccactaggatgagtgttcctgatggaagagcagatggcgtgctttctctgcacgagtcatccacaaaggatgtacagccagctcattaacatctttcattggaagaagtctncactgagagttaataaagccattctttgtggaatttgataataacatttttttgtttagtcattttagttgtttgagtactctatcttaaaggggaaagacaagctccctttttga

SEQ ID NO: 16005 - DNA, 417 bp, Zea mays
  Clone ID: LIB3279-228-Q6-K6-F7
ggtataacttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttgtgttctgcaactatggacgtctcctttgttgctgtataaggcatgatttgccatcattctgttgcttcggtgatgcttgcaatgcaatgagaatgtgttggaacg

SEQ ID NO: 16006 - DNA, 582 bp, Zea mays
  unsure (1)..(582): unsure at all n locations; Clone ID: LIB3279-228-Q6-K6-F8
tctacctaccggnagcagnagcacgccgcacgagccctttccgccgccgccaaaatggtgaacgttcctaagaccaagaagacctactgcaagaacaaggagtgcaagaagcacactctccacaaggttactcagtacaagaagggtaaggatagcctgtctgcccagggaaagcgccgttatgaccgcaagcagtcaggatatggtggccagaccaagcctgtcttccacaagaaggccaagaccaccaagaaaatcgtgttgaagctgcagtgccagagctgcaagcactactcacagcacgcaattaagaggtgcaagcattttgagattggtggagacaagaagggcaagggaacatctctcttctaagtttctcatcacccatctcgatgttggatcgaagctgtgggtctactactgttctaaaaactcgtcaaatttcaatgttactagtagttctgaaaagcaggtcatgctgtgtatcaaattccaatgcctgacatttgcactgagtgtggggttgtcttttggctaaatgaagttttgcaccctgaatcttattgaatgtgttggtgtgtt

SEQ ID NO: 16007 - DNA, 641 bp, Zea mays
  unsure (1)..(641): unsure at all n locations; Clone ID: LIB3279-228-Q6-K6-F9
aaatgtcgccctctcaacttttgttgggtccgtctgtggattgtccccggcctccttaccgtcgcgtccaaatcatcctcacaccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgttgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgnctggagttaatgcaagcgttagtctgacagccaatcctgtagccaacctctctgctgcctttggcactaaggctctcgcagttggtgcagaaatctcatttgattctgccactgggaacttcaccaaatacaatgctggattgatgttcactcatg

SEQ ID NO: 16008 - DNA, 623 bp, Zea mays
  Clone ID: LIB3279-228-Q6-K6-G1
gtccagtgccaactgctggtacatggttgggcagtaatcgtcaatcgttaatgactcctccacaaacgaatgatcaaaggggatctttaattggtgaaatcgctccagcacattctgcaccatctactgttacaaaaaatgccctctcagtggcaccatggatgggtcttctattgggtacgtgtctcttgcacattttgattggaaacacacatagggagatgccaagtggaactgtcataccagttggaagaaggcttttagtgtttgtggagggtcatggaaattcatcgctcagccatggcaatggaagtgaaattggacgctatcttggttgggctatggcaataatttatatgggtgggcgccttccccagattttgttaaacatgcaaagaggccacgctgaggggttgaatccattaatgtttacctttgctttactgggaaattcaacatatgtaggaagcatacttgtaaatagcttggactggtcgaaagttggaccaaatctcccgtggctcgtagacgctggaggatgtgttttgctggattcttttatcattcttcagttcctttatttccattatcgggaagcaagggagctttcagatgagcacgac

SEQ ID NO: 16009 - DNA, 662 bp, Zea mays
  unsure (1)..(662): unsure at all n locations; Clone ID: LIB3279-228-Q6-K6-G10
ttttattattctttctccccgcgtgctctctatctctcccctctttctctccctctgcccgacgactaggccgccgccgccaccgccccgccgccgccgccgccgccgtgcccaggtctttgtcggtccttgtccggcaacgagcaccctacagatggctgggaggcacaccattattctgatgcagccatctcaaaatagggcttctagaacatttatggattacaattcgattaatcatgcattggatggaatctgtgggctttatgaaaggaaaattagggatatcaacccaatgatcccaaacataacttatgacatcagcgacctctataacttcattgatggcctagccgacattagtgcgctggtttatgatcactcgattcaggcattcctgccatatgatcgacagtggataaagcaaaagttgtttcaacacctgaagaaattggctcagcggtagcacaactgttgtttgttctgatgccttttatccaacaagcaagcatgcgtgacaataggtgtccaatcagtggtattgggagttgtttcttgtaaactntgtaatgttacatggcagatttgctcccttgtattctggatgtttgactcggattcattggtggcttgcttgtggttgtggtatgctaaacttgttt

SEQ ID NO: 16010 - DNA, 618 bp, Zea mays
  Clone ID: LIB3279-228-Q6-K6-G11
cggacgcgtgggcgctgaaccgccttgcgctgccggtgatcttcccggattgtcgcccatgatccacgcactgctcgaccaacccctcccctgattttctcgctgacagtccggattgtgcggagggcagctaacagcttcgccaccggccgcggaactgtaccccgagagctcgggaaatcaccgtgtgattcaaaaaacgaccttctggcgctatataaatgaagtcggggttccgttcttccccttcatatcctcctgaccacgccaccaagcgcaggaaatcgagaaaagcagtgccacggaggggagatccatgtcgctgtcgtggccggcggtatgaaccaccgttcggggtcctgtgaggggtctgggtgacccatcctatcctggcggagattactgtggcatctacgggaggattgggctccgtgatccgactgaattgctcgccggaatagcatacccgccatggttcgacctgcgcgcgtgggcagcatccttcgcacccttgcgttgcggtgaggacacgtgtcatctgaagacaagttggtacttggaatctcaagtcccaggtcaagaacaggtacccgcagatgaggcgcatggaggttgctg

SEQ ID NO: 16011 - DNA, 568 bp, Zea mays
  Clone ID: LIB3279-228-Q6-K6-G12
gcgagctgctgccacccctgctgccgcggtcgaccgccggccccggaccgagatggacgctcggtgggcggtgctgctcgcgctgctggtcgccagcggcggcgtccgtgtctgcgccgccgctggggccaagggcgccaactggctgggcgggctgagccgcgcgtcgttccccaagggttcgtgttcgggacggcgacgtcggcgtaccaggtcgagggcgccgcgtccaccaacggccggggcccctccatctgggattcattcgcgcacgtcccaggaaatattgcagggaatcaaaatggagacgttgcagtggatcaataccatcgctacaaggaagacgtcgatctcatgaaaagtttgaactttgatgcctaccggttctcaatctcatggtccaggatcttcccggatggcgaagggaaagtcaatccagaaggtgtagcgtattacaataatttgataaactatctgcttcagcaaggcatgactccttacatcaacctttaccactatgatcttcctcttgcgcttgagaagaaattggaggggtggttaagcgcga

SEQ ID NO: 16012 - DNA, 562 bp, Zea mays
  Clone ID: LIB3279-228-Q6-K6-G2
cccactcccagtcccagctcgtccgctgagaaggacagtagcagcctcaaatccgcgcagctcctggagctgatgcgccagcacctggccaccgacgccggcaaggagctcaccaagaaggttggcctcgtctaccagctcaacatcgcccccaagaagatcggcgttgatgaggagatcttcgtggtcgacctcaagaagggcgaggtcaccaaagggccgtaccagggaaagccggatgccactttctccttcacggacaacgatttccttggaatcgccaccggcaagacgaatccacagattgcattcatccgaggggcgattaaaatcaaggggagcatcagtgcggcgcagaagttcacccctgacatcttccccaagcctgccaagctgtagaaggttagattgtattacttggtcgaggtgaataataatgtttgcaagcttcaattactatgtacgagatacaatgagtggaacatgaaaagcacgttctccgtgggaatttggatatggttgaactttcacgtaaatcaagctcaatgttcgtttctcgtga

SEQ ID NO: 16013 - DNA, 492 bp, Zea mays
  Clone ID: LIB3279-228-Q6-K6-G3
ggcgggcacgtgcaccaccgaatccctctcagaactttttttttcttagtgctatgctactgtgcgatcgtcaggtataacaaaatgtatattcttaaggggtgtttggtttgcccctgctaaaatttagcccctatcacatcgaatgtttaaacctccgttcagggtattaaatgtagtcggattataaaactaattttctctcttttgtaaagcaagtgctgataacgtgtaaagtagaaactgtgcgagaatgaaatgagaacctctgtttctttattgaataaagcaatgtatttatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaagggattcaaattttatttacccggtctttcgcaacgcaaaactttttttt

SEQ ID NO: 16014 - DNA, 343 bp, Zea mays
  unsure (1)..(343): unsure at all n locations; Clone ID: LIB3279-228-Q6-K6-G4
gccttcnagnaagatccatgtcagtactcgtcaggggagcttggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcttgctgtgtgggaaagatgtggttttt

SEQ ID NO: 16015 - DNA, 633 bp, Zea mays
  Clone ID: LIB3279-228-Q6-K6-G5
gggcatgcaagcataggaggtacagctgatgcttatggggagcaagaagccaagcctatgcaggtagaaggtgaagtcacttgcggtattctcgaatttgaaaaagtggataaggatggtgaagagggtttgtgtgatgactacacggttggtgttgtttcttctaatgaggaaacagagcttcctatgaaggaaaaagtagatgaagctgtccccagtgttaatgttggtgggccagagaaagtacctgacaatacaagccaagataccaagacagttgattttattgatgaaatcacagcagagtcaaactttaaagctgaaaatatggttgaagtgaaaagtgcagctcgtgaagttgacaaaacagaggtaaaagatcttgcttttgctgatgaggctaatgtagctcctttacaccttcaacgtgactgtgaatctgttatggaaactatagagcatgagaaggtagaattaccaggtggttgtcaagctcatgaaattgtgtattcttcagaactagaaccgaagaaagagtttgagatgggggttgatggtgctgttccattgcaggagctgcagcttctgttgcctctgttttccaccatgagccaatgtccattgatttgtctg

SEQ ID NO: 16016 - DNA, 352 bp, Zea mays
  Clone ID: LIB3279-228-Q6-K6-G6
tgaaccctctatgaaacttggctgttaagcagtgagaaatacacccatactgagatcaatgtcaaccagctattgttaagtcggatgagaaagtcgttgttgcagactttgttgagtcatctgatgggaaaaggtcttggtgtgggtactagcaatcctctggtaacagtgcccggaggtggggaacacatcaacacaccagtcgtttataggtcggatgcaaatactgcaacttctgtgaagcccccagcggaaaggcctaggtggttcgatgggataagtggcctctttcatgatgttgttggttttgacgttcttgtgagagcggttctgggggttttctgtgttgctg

SEQ ID NO: 16017 - DNA, 660 bp, Zea mays
  Clone ID: LIB3279-228-Q6-K6-G7
gtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctcgtgtttgttgttgcccatctgtgtttttgattgaagtcgctctgtgtcagttgttagtgc

SEQ ID NO: 16018 - DNA, 199 bp, Zea mays
  Clone ID: LIB3279-228-Q6-K6-G8
cgtccgttttttaaaaaaaaaaaaaaaaaaaaaaaaaaaaaaaagggaaggaagaataataaaaaataaaagaataaaataaaaaataaaatgaaaaaaaaaaaaataataataaaaaaaaaaggtaaatggggtttgggtggttcgtggttttacaacgttgggtcgtgggggaatccctggtttttttcgttttttt

SEQ ID NO: 16019 - DNA, 574 bp, Zea mays
  Clone ID: LIB3279-228-Q6-K6-G9
ccccgcgtccggccgcctcccggctcgcgactcgcgagtcacaggcgcagccgagcgttccttggggacgaggctacatcgcgatgtggtggagggcggtgaggcgccggtgggtcgcgacggcgcggcccgcgtcctccgcggcggcgggggcggagaagagctgccgcgccgtggtggtgccgcgtttcggtgggccggaggtgctcgaggtcaggcagggcatgcctgtgcccgatctgaagccgcaggaggtgctcgtgcgcgcacgcgctgtctctatcaaccccctggacctccgaatgcgatgtggctatgggcgctccatattcgaaccactcctacctctgatcattggtcgggacattagcggtgaagttgcggccaccggaactttggcatcgtctttttctattggccaagaagtgtttggttcgttgcatccaactgctctcagagggacatatgctgattatgctatcctgtcactggacgagcttactctcaaaccatctacactcagtcatgtggaggctagtgcaatcccgtttgctgctttgactgcatggcgcgc

SEQ ID NO: 16020 - DNA, 590 bp, Zea mays
  Clone ID: LIB3279-228-Q6-K6-H1
ccccgcgtccgctcccccaaggccccaacccacttgagcgagccctagagaaggcaaaagccatggcgtccttggttgttcgtgccgccggcgccgccgccgccgccgcccgtcttccctccctccgtcctcgccgcaacggcagcggggtgctctccggcttgagggtcggaacagggcactacggcgcgcggctcgcgcttgcttcgtccacagcttctcacaaagagttcaagatcgcctgccttactgtcgatgacagcagtttgggcccgggggatgaatattttggcctctatactcctaagctgcttgcagttactgaagatgattatgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcaagctgatcgcgagcggatgcatcgacctcctggttggtgcgatgcgccgcacccccgcagagaaaagcgcccactgttcttggtgtttggtgagctgtacccggtatttg

SEQ ID NO: 16021 - DNA, 592 bp, Zea mays
  Clone ID: LIB3279-228-Q6-K6-H10
gaaaaaatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatgggcaacgccgggcccaacaccaacggctcccagttctttatctgcaccgtcgcgaccccttggctcgacggcaagcacgtcgtcttctgccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtc

SEQ ID NO: 16022 - DNA, 558 bp, Zea mays
  Clone ID: LIB3279-228-Q6-K6-H11
cagccagccaccgaccacccgcgcagcgcaggacttggggagcaagcaaggcgaagcggcctgccatggattccttctcgtcctcgccgtcgtcgtcaggtcccggcgctaacccggacgttgttatggaacagatcaagacgcagctcgcacaggcttacgcgcaggagtttctcgagaccgtcgggaacaagtgctttgaaaagtgcgtgaccaagccaggatcaagcttgagtggaagcgagagcagctgcatatcacgttgtgttgaccgctacattgaggccactggtattgtcagccgcgcattgttcacttcccagcgctaagatcacatgaataaggagatggtttcgaagatcgctcgtgagagtaatgtcgccatgagttttttgacttgtcggaatacaatgacatttgatgcttggttattcaaaaaaaaagtctgcctatagactcaggtttcttgtacacctatctgctttagtaatagagaaacgtgctctatttaagtggctctgatgttaatttatgctcatcatgtggtttgtttcgctt

SEQ ID NO: 16023 - DNA, 626 bp, Zea mays
  unsure (1)..(626): unsure at all n locations; Clone ID: LIB3279-228-Q6-K6-H12
aaattcttcctctcctccatttcctcccttcgccatcatcccctcggctccgctttccttccctccccggctccccccgccgctgccccgcgcccgtggagttcttcgatcgagagtcctcggagcctgaagcacctcgtccaacaatccgggaccgcacgagaagagagagagggggtggtttgacacaagtcaggcacccgtcaagattcggctcgatctgctgcgggacatggagctggacagcatcgagtgcgtgtcctactccgacggcatggaggacgacgacgacacggccgccgtcacctcgtcccagctccctcgccccttcctcaaatcctcctctaccgccggtgctgccgccgccgccgccgcggccgtcaacgtggtcgtcgtctccgaccgcgccggtgccgccgggacggtagcgggagctgggccgctggtgatatctccggccacgggcgtgcatgagcttctcgagtgccccgtctgcaccaactccatgtacccgcccatccaccagtgccaaaatggtcatacntctgtgttccacctgcaaaactcgggtgcacaaccgctgcccaacttgtcgacaggagctcggtgacatcaggtgtctggca

SEQ ID NO: 16024 - DNA, 640 bp, Zea mays
  unsure (1)..(640): unsure at all n locations; Clone ID: LIB3279-228-Q6-K6-H2
cacaaatttagccaataagttgtatagccgagtgaagctatgtttgacctatgctacgacgagccatcatcacatttgcaaaatgctaaagagcaaaatgacaccaaactaatggaaaatgtaatccatgttctatcaagatatttcttaccgctgcaactaggcacaactgacatagtcttcagtcgatgccatgcagacgaacatggaggttgtgttcgaggtgctgaagagcctagatgacgttgaggagttggaccccgagtagctgcatgatcctcacaagctgcacgcatgcatggagaaggacacctccttgtcggactcgtgcggcgtcggcccattcgggctggtggtgatggcgcccgaaggcatgcagagcaggagtagatcaccgtattcttcagggagtgaccaggatctcagcttctcgatctatgcttctttgtgatttctcttctaatttgtctaccttctttttctgcccgcagattggagcaagagcaaggtggtcagatctagatcgaaagtcagtgagacgaaagctgtttttacctcactggtcaagcaacactattcactctttgatgcaacatgggaagctntatttcctgaagcactagctgngaagtcagtgata

SEQ ID NO: 16025 - DNA, 636 bp, Zea mays
  unsure (1)..(636): unsure at all n locations; Clone ID: LIB3279-228-Q6-K6-H3
agtacacanccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctcctcaagtacaccgaggcggtgccgatgctgacgttcgccaaggagaagcttgagacggcggacgacgagaacaaggtggtgtcgtacagcgtggtggacggcgagctggcggacttctacaagaacttcaagatcacgctgaaggtgactccggccaaggcggagggcgagggcggcgccgtcgtcagctgggccatggagttcgacaaggccaacgaccaggtgcctgacccggacgtcatcaaggagaccgccaccaagacgttccacgacctcgacgactacctcctcaagaactagatggagcgacaactggagatggtccagtacagttcagttccagtccattcatcgacgcgtcacagtctactagtgcacgtcgcttgtgtggtggggtgctggtgcctgctggtttcttaatttgc

SEQ ID NO: 16026 - DNA, 511 bp, Zea mays
  unsure (1)..(511): unsure at all n locations; Clone ID: LIB3279-228-Q6-K6-H4
cgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgagggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggatgccnc

SEQ ID NO: 16027 - DNA, 644 bp, Zea mays
  unsure (1)..(644): unsure at all n locations; Clone ID: LIB3279-228-Q6-K6-H5
ggnagaaggattactctctgcatagaaaagcactagctgatgcaggggtagcaaggggaagaaatcaactacgtgaatgcccatgcaacttctacacaagcaggtgacctgaaggagtatgaggctattgtgcgctgttttcgccagaaccctcaactgagggtgaactcgaccaaatcaatgactgggcatcttataggagcagctggtggaatagaagcagttgcttctatacaagctataagaactggttgggtccatccaaatttgaatttagaaaatcctgaggacactgtggatgtgggcatcttggtaggatcacagaaggagagatgtgaggtgaaggtggcgttatccaactcattcggcttcggtgggcacaactcatcaattctctttgccccctttaaggaactgccatcttcctcatcgtccaaatagattcatatatcntggatctccacatagaagacaagtggactctgcaacttcctcggtgccatagatattacagggaggtccaaactgagcgtatctgagcgaacaaaacatcagcccccctacatgtttcatctatatcacgaagttgcagatatgtggtaactatcaaaagatttaccgtacctggcccagtgttttcgcct

SEQ ID NO: 16028 - DNA, 435 bp, Zea mays
  Clone ID: LIB3279-228-Q6-K6-H6
tgtcgctgtccggcgtctggcggtctgggggagaccagtgattttcctacgcacgcctgccaaaagtgggatggagttgaacgcaaaatgtgttgtttgtcattgggtagatggaggaggacacctcgtttatacgcgcggaggaggtgtagtgcgactgtgcgagttgaatttgtaagaaactcagccgcatgcttgcttggagatacttgagatggaacggaaaactcaggtctcaacagctgtagagaaggtgaggggagggaagcaaacaacctagcttacattgtgatgaaacaaggcagatgagttctggacctctctctctctctctctctctctctctctcaaaaatggtttgccagtatagtctgtgacttaggaagattgtcatgcctgaatcccgatatagaatttctggtgtaattttcacag

SEQ ID NO: 16029 - DNA, 563 bp, Zea mays
  Clone ID: LIB3279-228-Q6-K6-H7
ccacgctccgcccagcgtccgcccagcgtccgcaaatccccaattcctccgagttcgagcgaccatgtcggggcgtggcaagggcgggaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggtcgcaccctctacagattcggcggctgagaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatatatgagtaccgaatttccgtgtt

SEQ ID NO: 16030 - DNA, 403 bp, Zea mays
  Clone ID: LIB3279-228-Q6-K6-H8
cccagcgtccgcccagcgtccggagaggcaacccctgttgcctacatgaactagtttcttgaggtagggatagatgactctttttttgcggtgtgagcagcaggtttggtgtagcattgtaagttgaataaactattgtacactgtaaaggcaaaggaaagaaagaactaccaacatcttctccattttctttcatttttgggacgaggccggccggtggcctgccatctgtggccgtgggagtgacagagcagcaaacattttgataggcgtataattcaatagggattttccagatacggcacttgtaacagaattttcttggaggtgtatatgaacaacggcgatgtgacaatcttttctgtacggaacatttatactattgagtgattgatttactatt

SEQ ID NO: 16031 - DNA, 410 bp, Zea mays
  unsure (1)..(410): unsure at all n locations; Clone ID: LIB3279-228-Q6-K6-H9
tcgatgctcaaacagctttgaagcctttaatagacctggctttgtctgtttcgaagctcaaggacttcacaggaagagagaaacctactgtcataacataatatttagatgttgtcctcggccataccaaccgagcagcatgggccaagaattgaactaatggcaaatatgtatcattaggacaaattccgccagaataagttgtttctcggaagtgttttgagcacctccagcatcttccaaatatatctccaataagatattagtgggataacatatgacagatgttgtcaaataatgtaaatatagatcgaacacgagacatgttttacgtggagaactcttgtntgaaaaaaaatcatggatgctaactcgtgattttcattgtagtcactatactagtaaagttt

SEQ ID NO: 16032 - DNA, 596 bp, Zea mays
  Clone ID: LIB3279-228-Q6-N6-A1
ggaacataagtgatcaacaacaaagtgttgatgattcacaaataaacaagtccttgctgggttacatgacgcagttcctacagaagcagagcagcgccgacagagaaaccagcaacatctaactacaacacaaggcgaacatcaacacaagagaagcctacaaagggcgagcgtgcaagcctaggaggaggtgaacttggtgacggccttggtgccctcagagacggcgtgcttggcgagctcgccggggagcacgaggcgcacggaggtctggatctcgcgggaggtgatggtgggcttcttgttgtagcgcgcgagcttggcggcctcgccggccagcttctcgaagatgtcgttgatgaaggagttcatgatggacatggccttggaggagatgccgatgtccgggtgcacctgcttcagcaccttgaagatgtagatcttgtacgtctccacgctcttcttgcccttcttcttgccacgcttgccctcgccgccctccttgccggcggacttgccagcggggacccgcttctccgccttgggcttcttcccggcggtcgtcttctcggccgcgggctcctcctccaccggct

SEQ ID NO: 16033 - DNA, 382 bp, Zea mays
  Clone ID: LIB3279-228-Q6-N6-A10
gttccagagtattcagggtattgtgtaattggagataatagtacaaaccaggttggtcgtcggtgtcgctacaaaacttgacatatgaatcatcatggcgaagacacgattacctctgcaatttacaaatcaagttactctataggtaggtagcctatccattgtccaatcgaacttttcttcactgcctgcgatcctacatgagcatcgatcgtggcagctggacttgtcacaccccgatggcagaatgcttttgtgggcttgtgtagcctaacaataaaacgattctacttgtcggtcggagtctcagttttcggaggagccgtgtgcctctgggcctgggagcgacccagatctaagttttgcatctcactggcgagca

SEQ ID NO: 16034 - DNA, 605 bp, Zea mays
  Clone ID: LIB3279-228-Q6-N6-A11
catcgggaacatatataagtatcttgtctccgcaaaacttagcttaaacaaaagtgccacagaagcaacacatagcatctgtccataaagattaaggtaaccaactgccttagcattgtccttatcgtaagatagaaacctatctaggacccgatcaaactgccatttcaaggacacagttgggaccttacacctcaggaggtgccaagaccggagggcgcggctcgtcctcgtccttcggggtgtggatggtcaccaggtccggaagaggagtgatcgggccaaccttgcccttcgggtcccagtcaagcatgatcttcaccttgatgccaagaacaccctgtctgagaagaacgtgtctcacagccgagtcaatgtactcgttcactggctgaccagatgagatcatgtagccatccttgaacttcatggacttggctctttgggccctgagctttccactcacaatcacctcacaacccttggcaccactctccataacataacgaagaacaccatagcaagccctgcggacggcaaggcctccgaggagcttgtaacggagggactcggcctgcgcgatggcacagaggccacggttgaca

SEQ ID NO: 16035 - DNA, 603 bp, Zea mays
  Clone ID: LIB3279-228-Q6-N6-A12
gggggatcccatgcttttggaaccattctggcatatgaaacctttcatgcaatacaggtctgacatctttctggagagaaagagcttcaggagtggaaatataaccatcatgagctggtcatcagaatgttgtccagctgaaaatggaacacaaggtattccattcaaaggctgaagaatgaaactgaacggattgttgtcgacaatgacaatcctgccgaaatcttttgacacgcaagaaagatctttcacatgttctctgtattccgtggtaacagttgatgggcgatagagacgaagtctgaatctattgtgaacatctattcgatcaactaaaggtctagcataaccttctaaacctgctgtaaaaaggataaggtctgcaaattcactagttttctgcaagaactcatgcaaaccaggacgctcgaaaacagtcacatgattcaccttctgttttccttcagcatccttatcagatgatatgcattccatatcaaagcaatgtaatcctgcttcaacagcttgtgtacgtacaatagtaggaagactagatgattcatatgcagaaactaaagtctcatccaagtcaagcactacctg

SEQ ID NO: 16036 - DNA, 579 bp, Zea mays
  unsure (1)..(579): unsure at all n locations; Clone ID: LIB3279-228-Q6-N6-A2
cagttgtaaacaagcttttaggctggtgattacacgtggagtggcaatagcagtacaattgaacatatagaaatgtatggtggattactgaattgcgtggacttgtaaacggcctcgaaccaggctacttgtatatgcgtggagaggaaccctcgaggctgttcggcggagctttaccaagctaatggggatcagtgcaccgactcccattaccatgtgtacgtgtgtttgcgtgctgctatgacgactactttcacgcacgcgcacacagaaaacgcgatgctaccactccatatgactctaagatgttttgacatggctgttcggctgcttgccaataaagagtcacgtgggccgaaaggagaaatcataaataatagaaaacattatatggacatgcgtttctgggtaagtttgtttcccatcattaatgtattaatatatagtatctacatctaatcctcatgtggacatgtatatatattatccagagaatggttggttttgataaacttccaaagtaccatcaggatcctacagcagnaagagttagccaaaacactcgattgttggccatca

SEQ ID NO: 16037 - DNA, 599 bp, Zea mays
  Clone ID: LIB3279-228-Q6-N6-A4
aaaacataatgagcacaggcttcaatttcaaacaacaaacttattcatgatttgtcatagttctgggtagtacgcacacacaacacaaccggtccattattaaaccaacactgacacgactcatgacacgaacagcagatactttgacaacctccatatggagagggcaccagacgacgcaggcacatcggcagcttaaacgacccatgacttactgaccaccacggagacggagcacaaggtggagggtgctctccttttggatgttgtagtctgctaaggtgcggccatcctccagctgtttgccggcgaagatcagacgctgctggtccggggggatgccctccttgtcctggatcttcgccttcacattgtcgatggtgtccgagctctcaacctccagggttatggtttttccagtcagggtcttcacaaagatctgcataccacccctgaggcggagaacaaggtgaagggtactctccttctggatgttgtagtccgcgagggtgcgaccatcctccagctgcttgccagcaaagatcagacgctgctggtctgggggaatgccctccttgtcctggatcttggccttcaca

SEQ ID NO: 16038 - DNA, 603 bp, Zea mays
  Clone ID: LIB3279-228-Q6-N6-A5
gaagttaaacatgaaattttttgattaggtggcagcatgttcaaaatattcttcgaatcgatcatttcatgccacgcagtacaatcgaatttttaggataagcaaccgtcccgagtttgtctaaagagacccaacaccactatacgagtgacaccggttgaaaaaatatacaggggaaagcaaaagaatgatggcatgagataattggttgtgaattgcagcacaccgattgcagactcattcaactcccccatgttcctccttcacagcatttcctgagacctgcggacacattgcctaaccttcttcttgaactcatcccgcttctctctccaatccttggcagcttcaatatttgctggagactcgtcattcggactagagagcattgaaatgatgctcagaactatactttcaaccgtgtgcactggtgtccaccgttcgcttgcaagctcataaccactgggatcttcaccaggtggatgaagaatagaaatgcaaacacgcccatccggataaacattcggatgccacatcccagaagtaaatcttactgatggcgggctgttgggatagttctgggggaaggtcattattgcattg

SEQ ID NO: 16039 - DNA, 600 bp, Zea mays
  Clone ID: LIB3279-228-Q6-N6-A6
gataataaacacgggcagcaccagggtgcttcacataatactctgctgctgttactcggtgactacattaataggacgatagttagacggtatatctggctgtttaagcaactgcgatacgaaagagcaactaatcaactacgtagtgctttcagacttgtttgtagaagagaacatatgcttggtcatgcaagacatcgttctcgccaacgggcacaacagcgtcatcgtcaaagcgaagccattgcccgtcggcatgctttgcgtgagcagtgtagtgacctctgtaagggtccctcccatgatgagtgatggttgcaacaagctcatattttctaccctcttgtgatggtgagctcagcagatcacgactaagaaccagttcagatgtgaagcggagtggcttatagattttagtgctcccatgatttccataactgaacctcttcaagtgcaggatcattatttttgaaagggcgtgtatcttgaatgactttctagctgtcaccaaaccagcctttccagcagttgttctgtatccttccaaagatcgggggtagagaacagaacgaatgcatcattaagtgtctgaacagcatc

SEQ ID NO: 16040 - DNA, 230 bp, Zea mays
  Clone ID: LIB3279-228-Q6-N6-A9
gggctaattgaactgctaaccaacatttgccacacacaggatatttattcatctgctccgctcacattaggaggagaaggcgatctgacgacaaccgaaaaaaaagctgccagggaatacaacaccctagtagcatcctaaatagcaacacagatgtgtatatactcaactgacaatctaagctctactatgggagactaggcgattccatagctctccggacgcgtggg

SEQ ID NO: 16041 - DNA, 254 bp, Zea mays
  Clone ID: LIB3279-228-Q6-N6-B1
gaccattaaacgcacagcagcaaatcactatcactggctgcggtgaaccatataatacccaggggcaggagatccgttcataacataactggataactgcaaagccaaatacccgattcagcgagaaccaccatagggcgagctaacgcaacataacctacatgcaatttatttatgaactgaccaagatgcaggggcaggtagaaattctatggaggcggactacacaagatgagcaccgtgcactggaatgc

SEQ ID NO: 16042 - DNA, 233 bp, Zea mays
  Clone ID: LIB3279-228-Q6-N6-B10
gaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctag

SEQ ID NO: 16043 - DNA, 590 bp, Zea mays
  Clone ID: LIB3279-228-Q6-N6-B11
gatgtctcttcactatgtatatatatatgtatacatttcatgagatcaatacaactgtcactttctctctacatttctgtgtctcgttttcactgcgctccaatacgttatcagcactgctcgcgagaatagagaagttgttgttgtacaaagaagaagaatatgccgctggcaagaaggaaaagatcatcgaacaacaggagcatcctccaccggtggccgagcactgccgcatcgagatctctctcgagaagtcatcatcatatgttgcgtttggtgcggtctcgacggcaataattactcctgcaaagacgcatgaaagaaatcactggagtgttgaaacggaggcttcaacatttctttgtcctatgtgatgtgaaatcaaaatcaaatgaatctgatgaccggcggcgagcaccaagcctggggcaacctccaacacaacggcatcttgcaaatcccttcgggcaaatgtaagcaaccatggcatttttttttctctgcaatatacggtgcattgcttgcatccctcgctcaaacgtccaaagcgttgcaatggatggcggttccatgtgacattcttgcgtgca

SEQ ID NO: 16044 - DNA, 591 bp, Zea mays
  Clone ID: LIB3279-228-Q6-N6-B12
gcaccaaaacaactgcatttcacagtaattttcattgttcactgagaaccaaaaccttagatataggtctcaaagtctaaacatgggtaaaaacacaagaaaaaaatcgactgccagaaacgtagttctagtgcaagtgcaccaggatacaagctccactcaacggttggccttggcaacacgctcaatctcgtccttcttcttgatggcgtagctgttggaagagcccttggcagcgttgatcaactcatctgcaaggcactcagcaatggttttgatgttcctgaaagcgctctccctggcaccagtggtgaggaggtagatggcctggttcacccttctcaggggtgagatatccacagcctgccttctcacaacaccagctgaaccaatacgggtggcatcctcacgtggtccactgttgataatggcgtccacgaccacctggatgggattggcgtcagtgagcaggtggatgatctccagggtgtgcttcatgatgcggacggccatgaccttcttgccgttgttgcgcccgtgcatcatgagcgagttggtgaggcgctcgacgatggcgcactgcgccttgcg

SEQ ID NO: 16045 - DNA, 601 bp, Zea mays
  Clone ID: LIB3279-228-Q6-N6-B3
tttttttttttttttttttttttttttttttttttttttttttttttttttttttttttttttttttttttttttttttttttttttttttttttttttttttttttttttttttttttttttttttttttttttttttttttttttttttttttttttttttttttttttttaaaaaacccccccccccccccggggaaaaaaaaaaaaaaaaaaattggggggggggtttttttaaaggggttttttttttttttttacccccccagggggggtaaaaaaaaaaggggggccccccccccccaaaaattttgctccccccgggggaaaattttttttaaaaaaatttttgggggggggcaaaaccatttccccctgggggggggggggaaaaaaatttttttttttttttgggggggggttttttccctttttaaaaaaaaaaaaaaaaaaaattttttttccccccccaaaaaaaaaaaaagggggggggggaaaaatttttttaaaaaaacccctttttttttaaaaaaaatttaatttttccccccggcaaaaaaaaaaactctattttgggggaaaacccccttctggggggggg

SEQ ID NO: 16046 - DNA, 543 bp, Zea mays
  Clone ID: LIB3279-228-Q6-N6-B4
gcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgccacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtga

SEQ ID NO: 16047 - DNA, 498 bp, Zea mays
  Clone ID: LIB3279-228-Q6-N6-B5
gcaacgggaaacacaaatcttggagcccaacaagaacaaccgggatggacatacagttttttttcctgggggggttggctttttaggaaacaagcccccatcggaaaacaactaagtttctttaagccataattctaactgcctgacgaatgccccccaatttttcaaaaagctaggactggcccaaatgccccgaaaccaagagggacagaaaagccgtcagcttttattttggacccccggctgtatcgggggggggtttgactgctcaccgatggggacgggatcatacctggggtcgtcggcgttggcgtccctggcgtggggagggtccctggaacactggaattggcccttgcgtgtggagggaccccccgtggcggcggcggcggtggcaacggcggtaatggtccatggggaaaaaaaaccggcaactgcccaggcccccgtggcgggcggaaggtccaggcggcaaaacccaggcatggccatcacccc

SEQ ID NO: 16048 - DNA, 306 bp, Zea mays
  Clone ID: LIB3279-228-Q6-N6-B6
gacttcaaaactcaataaaacgctagagcaaccactgacatgcttctcaaatccagtgaataataccagtccacacggacttaatgccaactagcggcaacacaaagcaatggggaactaattcgaacactaccagcctactaatataaaaaaagaagtgagggaacaggaaatcagctacaataatagcacggcacagcttcagcttcgacagcatagagcatctaaaacaatgggctcgaacaatatgcgctctcccaagattactgtccgtcaccagcctcacctttcggggcttctttgccc

SEQ ID NO: 16049 - DNA, 604 bp, Zea mays
  Clone ID: LIB3279-228-Q6-N6-B7
gagcaagtggaaagtttttccattccttcacggctcaactactggtggttcagcacaaaaaagaaccgctgtttgtaaactgctcctggtgcacattttctacactccgctgtgttttattatggaccacaaagcctcgttgcgccaaccataacggggcgggggggaaaaggcagtcaaaaaaaaaattttgcaagggatatcaactgttagaagccgggcgagttgcctagctcccgtgggcgaacttgatacccttgtcaatggaagacttgagctcgaccttgaggctttccagccccttcttctcgaagtcgttgagctcacccagaccaagcacttcctccactccattcttgccgagccgaaccttggaggcaaagaacggcaactctgtcacagttgattgcacaaaagagcactctacaatgtccggaactccattcagacccttcaagcatgcatctgcaaaaacagcaccagcatatgccatggacaatgttgcagagccctttccagcctttgcttcaacaacctctgtcccaccatcttgtgtcctcttggtgagagcctcaatgtcttcttgggacaacgaattgcttgc

SEQ ID NO: 16050 - DNA, 543 bp, Zea mays
  Clone ID: LIB3279-228-Q6-N6-B8
gactaataacatattctcaagcaacagcagagtatggtaagggcacaaaaaaaattcatatagtgattatagctctgctagtagactaaaagtcgggccagaggatacaactcaaacaaaaaccttggaaggtgatcttgcgttcacatggagatgaagcgagagctgttttgcccccacaggtgaggtttaaatcgtgctggcctgagccttgttgaggatgacaccttcatacttgacctggaaccacttcatggagtcctccttggtcaccctatgctgaatcccaacacgggacttgcacctcctgcggcgcgcgacgcggtagccagcacgctcgagcacgacgtagaagtccatcccatagatgcctgttgatggatcatacttgataccaaggtcgatgtgctcctggatgccgaacccgaagcagccggtgtcgctgaagttcctcctgagcagctcgtactccttgaccttgaggccgctctcaagcagctgcatggccttgtcgcccctgaccgtgacgtagcaggcgatctt

SEQ ID NO: 16051 - DNA, 614 bp, Zea mays
  Clone ID: LIB3279-228-Q6-N6-B9
gattgtaatatctttagcgtttatctgccacaatgttagttacgacacgagaaaactttctgctgaatgttcattcgaatgaaacttttgagtgcatatcatgagtggaagagtcgggcggccagaaacaggcagacattgaatcccaacttctttcaagcaactcatgtctagcagagcctagctaagaaaagggggaaaatgtatttacaaagcgaggccatcatatcagcatggacatcaggttcaggcccccactcactcaaatcctgttgcaaatcacaatcctgtgaaaaatggctttattcgataactgcagagctcaacacctgcatgaaagccacagcaacggccgagcaggtgctcacctctctactcctgtgccaactcaaaactggcaagaagtgccaagcctctgcttcgccctttgctctttgacactgcacttgcgtgagcggaatgtctcaggaaggagctcctggaacttctcgaggaacaggcaccacgtctcaggtttcatgtcagccagcttgacgaagctcacacttgaagggagcatgtcgtttgcacttccccagttacaatgctgagagccgctgtcattgctgttgctc

SEQ ID NO: 16052 - DNA, 472 bp, Zea mays
  Clone ID: LIB3279-228-Q6-N6-C1
ggaaacaaaacaatatctctcccccagagggcaaacttggcccccaacaaaagggggtccaaggcaaataaaaacatcgcaggcgcagaaacaaattgaggcccacctaggctgctctgacctggaaaagctgacgggcattttctttcctaaaaaaacacttaaaaacaccttttcctttcctaacaaaaattaacacgaattgccccaacgaactactcgagggctactgaaaaaaaaaaaccttttgggcccacaacccttttttcctgccagggggaagaaaaacccccccaagctctaaaaggggggaaccggcctgctactttgccttggaacctttgcccaccaggcttggaaaccctttcctgggttttttgggctttttgggaaatactctgaaactttggtcttgcttttcccgaaaaacatccagtccaaggccaagtcgtactcaaacgtggtgggctgg

SEQ ID NO: 16053 - DNA, 612 bp, Zea mays
  Clone ID: LIB3279-228-Q6-N6-C10
aataaaactcactctcttattaaattcttaccatattatcatattttcttatgtggcaacacatttaatcgagattgaaactcggacgaaatccccgctggaaatagcctagcaatgtccatgttcccagaaaacgtattactgctacttgtacatccacaatctttagcgagttattataaaactcatacaacatcctgaactctggaggaccaaaccatttatccgagtgtgacacgtcctatagtccatccataaacggatggcgctccacacacacaacctggtacagggagcctcctccagccgcaatcagtagtcatcgcctctggaaatgacctctttgcaagttggccggagtaagattgtgtgctcaaactgcgagacatagctccctctcacatcgcacaggggagggtacggctgaacgatgccattgtcacaaagattcttcagagccatgaggtacttggtctcaccaaggcggtccaagtaccggcggcaaaaggcgagcgttccgaagttgtggttgatggtcccaagcagttgcttggcctttgctaaccttaaaggcacatgtccgacatcaaagttcttcatgtaatgactgca

SEQ ID NO: 16054 - DNA, 473 bp, Zea mays
  Clone ID: LIB3279-228-Q6-N6-C11
acccaaaaagagagggggggactatcacccctaaaatatgggggggaaaaaaaaccgggggccctcgctataaaaggggggggtttatcccggccaaaaaaaaaattttagccggtgggccggaaaagaataaaaatatggggggaaaaaaaccaacggggggggaggacccccaaaaagggggggtttaaaaccaaaagaaaactttggggggaaaactaaattaacgggccggaaaaaaaaggctaaaaaaaggaaagccataaaatccgaggttttaaaaaaaagggggggcgggccatccggccccttaaaccaactccctgaaaactgggagaaaaaaactgggctgccccccaacactgaaaggggggggtttttgccttcctcggcaaagaggaacccgggccaaaaattaaaaacgtttttaggggggggttttttttagtggtttaagggaggaaaaggccccc

SEQ ID NO: 16055 - DNA, 562 bp, Zea mays
  Clone ID: LIB3279-228-Q6-N6-C12
actctcttaataggtagtagagattaagattctataaaatcaactggcaaacatccgaggcccattaacagcgcacgggaaaatgaccaaagcaaacaaacatcgggttggacaccagagcaccgagcacatggtggcgcgcacctagtctagtccaggaacttctgaaggaactcgagcaccttatcaacgtcatccggcaggacgtccttggccgcttccgccgccgcgaaacgctccccccacgcggcgaggagcggcgtcctcgccacgtccaggaccctgacgccgaccatcttctcgaacaccttgaaccagcccaggtagctgccgaggaccacgtccacgaagccgatggcgccgccgccgaagtagtccctcccgccggagcagtccttgaacgcgccctccagcgtctccagcgccgcgacgatccgcgacgccgcgtccgccttcttcccgtgctcccgcgcgaacaggaccgtgtgccatggagacccgaccttgtcgtcgacgaaggcggcccaaaagcgggcggtggcgcgtgcgtaggggtcggctg

SEQ ID NO: 16056 - DNA, 587 bp, Zea mays
  Clone ID: LIB3279-228-Q6-N6-C2
aacttaaaatctttgttctcatatttaaactccactttataaacagtgcagtttacaatacaaaatagtgttttaaatgactatggatagtacaaaatagtgttttgaatgactatgaataaactgccggatactgtgctaaagaacaagtctgcacgcgttcgcatttggttgattattcgtttgttcggtagttgactgtcaattctctggaataatttcagtttgttgaaatcaatttgcagcgcggtagtcggtagggtacaccatatgtagccatgtaggttcatgatcgagaaatccactcacgtgacagtatatattgtccagtgggatggggtggcatctgtctggttcacagctcaaatacaaggaattcggtgaagcttggatactttggttcccaaccgatctcagcccgagtttttgaattctccattctcttccccaatggaccgtcagtaccaataaagcctccaaacttcgtgtcaaattttccactattgttaacagcatccattatttcttgcctggaaagggcttgttgtcacagcccagaatattcgactccgcagtccctttttcat

SEQ ID NO: 16057 - DNA, 384 bp, Zea mays
  Clone ID: LIB3279-228-Q6-N6-C4
cagggcataaaccaaagtttcacttgcgagttgcaaaggatttttcaggagagcatgaaacttgacaaccgctccggtcctaaaaagtccccgagggggccctgactcatttttcagctaaaactacatagtttgctacaaaacaaacaacatgtcctaaacatcgtcctacataaattgctacaaaacaatcgcacaaacactatcacttcaaattgctccaatatctggaatcactgactcatttttcagctaaaacttaacaggactgttgtccaaaaatgggtagtcgccaagctcatcatcagtaggaaaatcttcaaccagctgtgttttgtcacccttgccttgcacatccttatccagcttttgacaatcatttcc

SEQ ID NO: 16058 - DNA, 570 bp, Zea mays
  unsure (1)..(570): unsure at all n locations; Clone ID: LIB3279-228-Q6-N6-C5
gccacgacaaaaaacatggtgcggcattccattacaagtggacaacgatcaatcaatgtaacaaagtcaacaggcgtagcagtacggtatgcggtattgaggaatccacttcagaatacaacctagcacgcgacaacaaagcaacgacagtaaaatagaggtgttaaggtccccattattagtgcggttccacgctgctgctacgacatatataatcacataaataccaatataataaaaccaacagcacgtccctgccccttcctccccacagcgtcagccagcctttcaccgttcagacttcaaacttcgcggctccccaacctttcaagatactgggccttgcgccctgcttgccgtccgcagtcatctccattcccgctgactccatgccatcgaacgacttggcggggctgtacggagctttgctcacgaccctgtcacgacgtttctcaaggaagcgctggagagagtgcctcctggcaatggnggagatcagcctgaagcttgcttattgagctagggtcagcaacaacctgagcttgtccagctgctacagaagtgctcatt

SEQ ID NO: 16059 - DNA, 367 bp, Zea mays
  Clone ID: LIB3279-228-Q6-N6-C6
agaaattattccatgcctccattcagtaataaccgaaggggccctaagatgatttgcatttgacagtgttcggttacagcttacaccagtctatgaaggaaaagcagagaaaaaaaacggagcgaagtccaatgtaaggcaaaaactacgaactgggcaacgaccgaaaaagctaaaaaaaggtaatgaatattatgaacacaaaatagtcgctctctctcatcagtacctctcccacggagattcttctatgttctccccggccatcaaacacgtggagttcagaatgtggtaaggatcagcacacacgtgctgctcgcccattgcaatgctcagtatctgtacagactctcaccggacgcgtggg

SEQ ID NO: 16060 - DNA, 398 bp, Zea mays
  Clone ID: LIB3279-228-Q6-N6-C7
aataggagaactccacagtcatatcgtcattcatgctatcaccaacaaaaaattgaatgggtttgagtttgataagaataaacgaatatgttttttgaggtattttttaagggaagacacaaatgatttctcatcaaagggggttgctactgaaggcgtaaggggtcaacaaagtcaacaatatgtatgttgggggccaatattcacatcaacatgtacttggaccacccacttgtcattgacctccaaaaatgccgtttttaagttcacaatttccttcaacccaataaaacaaatcttggtaaaccaacatgtcgtcgggttgatactaacaagactagcttactccctcggggggaccaaggaaaccaaataggagggggcccccgacccctggg

SEQ ID NO: 16061 - DNA, 397 bp, Zea mays
  Clone ID: LIB3279-228-Q6-N6-C8
gagggggaatcattatcattaccatttacgttacatttcgggaaccaaacgacactaacaacttataaaccatttctttaaaccaccaaagataactaaacaagctcaacatggagaagaagctcgttaagagattttgttcccctcatgctagcatcatattacaaataacattctccactggaacgcctatcacaactgggccaaagacagtttcagtttcagggcatctgatttaaacatgtcgaagtcgctgcattgcatttccagctcttaacatagatcaccttaggctagatcccattcagcgtgatcacaatctgtcgaggagtagcataatctcgatgttcacagagccaaataccctgcaaaattagcatgcttaacattaggtccc

SEQ ID NO: 16062 - DNA, 518 bp, Zea mays
  Clone ID: LIB3279-228-Q6-N6-C9
gggggggagacacaaaccacttttttattttggtgacggaacaacagatttacattttggcttttacaaattcctggaaactagacagaatgctacagcaccgcctaatccccattacaactttgccaaaccctaaagacactgccatttttttttttttcctagtttccatcaatctgagacgaattttacacgatgcccacaaagcaaacctcaatttatggaaaatgactataaatgcccctatacatccagttgccattttgggtacaaaaaaaacaaattgttgctcgtgtcggggcacattgagcaaacaaccagttttttgacacaacggaaacgaaatgtaacacactaggggtttccccatacaaaaactaagtaatgcaagcatgttccttgcgacccgtagcatatttcctaaaatgttccaaacgctgggggggccaactaccagaatgcttcaatcaattaacgactggtttcccatcaaaattagcaaaactgagctgcatttg

SEQ ID NO: 16063 - DNA, 535 bp, Zea mays
  unsure (1)..(535): unsure at all n locations; Clone ID: LIB3279-228-Q6-N6-D1
gacaggggaacaacatatcaatatcattggacaaaaatagctgcgaacaaaaaccttgctcattcttctctcgtctcgtttcatagcgggagcaaccaaagggaacaacaggggtcccaacacctaatccaaaggtagaacggactctaacacggggacagaagcgaacgggaacacgatactatagatagataaaataactcggccgaagccaggatgggcccacacataaatccctccagccgccgccgccgccgccgtagccgccaccaccaccctcgcgccgaccgccgtagccgccaccgcctccgtagccggcgccaccaccctcgcgccgaccggcggagccgccaccggcgccataaccgccggnacggggcccgccaccataaccgccgccgccgcgaccgccgtcgtagtcaccggcgtcaccgtcaccgccacgggactgggcctggttaatggggatgttacgggcgtggagctccttgccggttttgcttttgatagggtngaccatggggtttttgggggg

SEQ ID NO: 16064 - DNA, 616 bp, Zea mays
  Clone ID: LIB3279-228-Q6-N6-D10
cagagaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgacttcttccttggcccgccgaccttgcgcccggccgctcccttcttccccttaccccct

SEQ ID NO: 16065 - DNA, 486 bp, Zea mays
  Clone ID: LIB3279-228-Q6-N6-D11
aatgggatcaacgatcacaagaaagcaaatcaaatttttattctggggggcatttccatccctcaagcatcagcgataaacaaggtgccatggatttgcttaaaaactaattgcatcagcaaaacagacataaaactgcccatcagcttcaaattcactgagttgatggcgtgcaaaattgtttgctagaagggcaaacttggaatcaatttgcaggcttcttctcaggtggggaggcatagtactctttgccggtggcaactctgggcgtattgcccccaatgtccagcacagcagatgtgaaagccaaacaggagcctccgatgagggctgactgaatactctttcctctgtagccgcaaacaaaggctccggcaacaaacgccccgacggccccgttgacaaaatcgcgctttttgcgctggctctgcacgaactgctcgacccccatgtaaaggccccccatggtggcaaagggggccccct

SEQ ID NO: 16066 - DNA, 569 bp, Zea mays
  Clone ID: LIB3279-228-Q6-N6-D12
aaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcacagctgctgcagcgactgcaagaaggtgaggtccttgaaggcgcccgcgccgccttccgagacgccgccggcgccggcaaggcgcgcactgaacgaagtgcaccgcgctttcc

SEQ ID NO: 16067 - DNA, 598 bp, Zea mays
  unsure (1)..(598): unsure at all n locations; Clone ID: LIB3279-228-Q6-N6-D2
agaccaaatttagcatcaacccttactggagaaaatactgaatcgttcttgcatcgcgtcactaataattgctaacagacagggcccatccggcaaaatcctttattctgtagacagaaggttcataaggcctcatgtggaccttcagaaagagccgtcaaagctactgtcccccccaccccccaaaaaaaaatttgtagcccgcgtaacaaaattgacgacggctgttagttctttgccgggggcgacttaggccgcaggctctcgatctccggtgttgtcacaacgaggtggggagcctctgggggagggtttcggccaccgcctccttgccatactttcccatccttgtctgcaaaactcctaatgtatgcctctttgttgaagttggagtaggatagattttttccaagggtaagccaccccgggcggatgttatgatcctctccaaagagttcgagccgcctccttccaagcgcaaaatgctcaatgatcctgtacatgtcctcaggcttctttgttgaaccatcggttggttcttcagctattattatatctgngtcaatattcgcatggatgacatggccatccgtgctac

SEQ ID NO: 16068 - DNA, 592 bp, Zea mays
  unsure (1)..(592): unsure at all n locations; Clone ID: LIB3279-228-Q6-N6-D3
gaaagcaaatgctacatttgtttcttggattggcaaagcccagcacatggtcntgatgatgacgaaaagttattcatgaattgaacacaagtatataatgatgatattcaacatccacactgctttgtgcagctcattagattcagcgcctaccaccccttcttttactcttcctccggctgttcttgtcatccgaatcactgtctgacgcagactcagattcagaagatgatgatgatgtgctgtccctcctgtgccttctcttcttctgcttccttctgtgttgccgcttcttgtcttcagagtctgaggaactataacttgaactggttccggaagagtattcagagcccgatgattcagagtcagagtcgaacaccgaagcagcactattgctgctatctgaatcactcggcgatcgatgcttcctcttactctttcccttttttctttcggctttctccttcttctgcttttctttcatcatcttctgctcctcttccctctcctttataatatcaggattctcaaattgataagaaaccggtacgcttttcttaagcttggggttcttaagctgctgcgttcttga

SEQ ID NO: 16069 - DNA, 190 bp, Zea mays
  Clone ID: LIB3279-228-Q6-N6-D4
cagccgcttaaaacatctcgtattattacgacacgggaaatagcaacagcagtgcgggagaaaatcacaagtcttcagaccatagaaaacctagggtggtaagacaatgatagaagagatgcggcctatgccttcacagcaacaagcttgtcaatgaggtcagcggcgtcttcaacgggggcaattgtct

SEQ ID NO: 16070 - DNA, 567 bp, Zea mays
  Clone ID: LIB3279-228-Q6-N6-D5
aaaaaagcttattccaattctcaattctgtgcttcaataatagactcatcggacacgcacaacacgtctagtcgacgcaaccaaacacaaccttaaatactaaaatagaataaaatacagggactaaacagtagtccataaaaaccaaacacttgttagctgcagcgacctaacatcatcaatcagtactcataatcttttcctatttgctcaaagttgcagatacacggaattggaactgcaattttgcaaggcttatcatagcatctgttccttgacaccaaggtaatctagcatctacatataccttacagaagtgctaaaacccagtgagagcaacacacagaacagtaatcaagttactggagctcaaaagaaaaactgcgagggagacatcgggggccagtccttcaagaaccaccagaaagactgcgtcttctagcaagcggtgagcttcgcgatctcttcaagcaagtacttggactcagctgcgaagtcgaccggtgcttcacccctcacggtgattctctgcctcttctcgttcatgtattcatgctgcgtgacgct

SEQ ID NO: 16071 - DNA, 256 bp, Zea mays
  Clone ID: LIB3279-228-Q6-N6-D6
caaccaaatggtacagccatttactatccatccagcaagaacgctgaaacagacaatatgttcactgaaaagaagccgcctatagccacaactacatgggaaaagtgataatatatcaaggctttacatccaacacaacgcagtagttgtagcaccgcccttgttcatatgttggctttttgctatttagtaaagtaggtacagtatccaacatagactgtaaaagaatagtgacgaaaattatacccttctcacc

SEQ ID NO: 16072 - DNA, 615 bp, Zea mays
  Clone ID: LIB3279-228-Q6-N6-D7
aacagaaggattgaagggcatcattattatcagaaatcatgtaatgtgactgatccaacacagtgaagtagccatctactgggtagaacagaaaccatagtactagcagaacccaatcacatgcatgatccaacataaccaaggtagatactagtagtagctagaacggacacatcaagatttgcgctagggcagtagtaagagcactgtagcagagatccaatcacttggagacttgaggctagtgactgcaaatctgtagacacgtaggtagctaggtgacgatggctaataaggagtggaagcagagaccatgccatcgatgtccgacttgacgttgctgaagacgttgtggagcagcacgaagatcaccactgataagttgctcccgaggccgtggccggcgagcgcctgaccgtcgacaccggtgaggtccaccttcctggcgaacaccgtgcctctgtcaagaggggtgccgccgcaagcgctcgacaccatcttgcgcacgatctccagcttctccatgatctgcagcgccatccaccacttggcacaccccccctcggcagtccacctcactgactcaaataccgggtacagctcaccaaacaccga

SEQ ID NO: 16073 - DNA, 600 bp, Zea mays
  Clone ID: LIB3279-228-Q6-N6-D8
agggagataaaataatgacatcaagacatcgattgagagactttgtcactttgacaccatatgagagaccattcgtccatgcttgacaaacagcagcgttacaagaacatcatctcaacttcgtctccacattcacgggcttatctacacgcttattcaaaagatactcgatcatgccggcgccagacctgcggcctggtcgcagccccgcgtcctccggcccgccttttactcctcgtccatgccgtcctcgtcctcctccatgatcctcatcttcttgacggcctgcgcggcgtcgctcctggtggagctgttggggacctggatcaggatgtccgacttcatccccgtctcagcgttcaccagaccgccgctccggtccaccctgtagaccagctcgtccttgccgggcgcggcgtcgatgtagaccgtgcagttctcgtcgatctcctcctggatcagcatcttcgacagctgcgtcaccaccctcttctcgatccacctcctgattggccgcgcgccgtacaccggatcgtaagagagagacaagatgatgtccaatgcggcgtcggtcacagccagagcgatgcccctttcggc

SEQ ID NO: 16074 - DNA, 222 bp, Zea mays
  Clone ID: LIB3279-228-Q6-N6-D9
gagcacacaattccatattccgtagatgaatacaactagtattccagtgatcatacaaactaagtggacaacactaaactcagttcacagcatcaccacttgacttcacatttcagttgattttgcacaaacataacaacatataataaaaagttgacacccacgagcaactagagtttttgggtgagagagagaggacaccagcgagcagaagatgagaac

SEQ ID NO: 16075 - DNA, 590 bp, Zea mays
  unsure (1)..(590): unsure at all n locations; Clone ID: LIB3279-228-Q6-N6-E1
caaagcaaaccctaattcacaacatagaaaaaaaaaaagatcttttgatatttccaagcagaacatttcacaaaacgatttaattgagattctacactgaaccgtaaatttaagtgcttcaacacactagacgatcgtaaatagcctcagcactatgcgatcaacataaccaatataactacaaatactcgaattggatcatatgaccaactaaagttcccgggggccaggcgcgcaggaactgaatcgaaaggaattcgagttgtagaggaaaccactcgctgctactgctagtacctgacgagagggagagaggggcggcggctcatttgtagtagagctcgaggcccatgccgtcgtggacctcgtagtccttgagggtgatgtggtccttgtagatgttgtaccacttctggatgcggatcttctcggggcgcgtccccgtctgcgccgccaccagcttcttgaggtcgccgatggtgtcgtcctcgttgcacttgacccgcaccttcttccccaggcggtcgttgagcaccaccttggacatctncgcctccctcctgcaccttccccgaacggacggacggacg

SEQ ID NO: 16076 - DNA, 198 bp, Zea mays
  unsure (1)..(198): unsure at all n locations; Clone ID: LIB3279-228-Q6-N6-E10
aagaaacacggcatttcctattccattaggaatgacataaagcaacttgagcgaagcagatacacagccaatcacattgcccgcttacaacctacacatgacaacatcggatccgcctccnnnaaacccttatgnnccttnnncttgggggacttggcggccttcttgggcgacttggcctccttgctcccgccgctg

SEQ ID NO: 16077 - DNA, 563 bp, Zea mays
  Clone ID: LIB3279-228-Q6-N6-E11
atcatagccctcaacattgcaagttgtatagataaacttctataacacttcacaatctgatagtcacttgctatccattgaaatcgctctacaaggttcctctctgatagtcacttgctatccattgaaatggctctataaggctcctctcttggtggcctctgttttcttggttatggtagtaccaacctagttggaggtgcggtacagtttcccaaaaacatggagcatagcgacaacagctatgaacccaatgctcatgatcagaaaagtgtttggtgacattttgcggcccgcagcctcatcggtgtagaactggagcatcgagctggcaccacctctgccagcagcagcaacgcttgtggtcctacgcctgcgcaggcttgcagctaccgtcgcactccctctagcaggtgcgtcgccattcgccaccatcttttcttaacacactctgacctgacgcctggcggtgatgaatccgttgttctccctctcgtcctcgtacacaccgctgtctcgggtattgtacctggcggggccagtggctggcggagtcgggggca

SEQ ID NO: 16078 - DNA, 596 bp, Zea mays
  unsure (1)..(596): unsure at all n locations; Clone ID: LIB3279-228-Q6-N6-E12
ggtcaaaactgtgctcatatacataaatctttttactagtttacaaagaatgtcatcctggacagactcaacgcaaggcagggngaaaaaaggaaaactttgcattcttgtacaacacttgataccataagacgtcacattccagttgaagatgttcttcctattctttgagcaccaagttttggttgcgctggctttgttcctcggcccctacctgacgaggctaagggtctggctttggttgctggtggaggtgctgcgatggcaccccataagtcgtcactattcgctacagctggcttcaaaggcttcccagatgattttggaggtgccgctattgaaccccagaggtcatcctcatcattatgtgatgttgatggcttgatgtctgcagattttactgcacttttaggtggtgcagcagctataggaccccacaaaggatcgtcttctgactttggcgctttcggtgggtttggtttagatgagtttgcaaccggttgctttggttgcaccactggacgtttctgagcagcctgtatattggatagaagagatggggatggcttgtcctcaaatgggtctacatcatccca

SEQ ID NO: 16079 - DNA, 291 bp, Zea mays
  unsure (1)..(291): unsure at all n locations; Clone ID: LIB3279-228-Q6-N6-E2
acagaactgaatttattcctcaaatgcaaacaaatacacanactgacgggaaaatgccgcatacgacagacatggatgagggtgaagaacatccatcatgtacttgttcactcgcgatgaatctataacacagacacgtgcggctgattttcactccgaataggtggagccgtgtgtccgcgttgaaacagaggcggcggcggcggncgtgaggtngncgncgncgncgnggnggnngccggcgnnccntcgcgcggngcgccgngcgnnccncggccggnngncggcggc

SEQ ID NO: 16080 - DNA, 607 bp, Zea mays
  Clone ID: LIB3279-228-Q6-N6-E3
agacgtgagcctcattttgacctcttaagtcgtggcatacattgtacatattacatctaccacgacattatgcacacagcaccgcggacatatagacttcaatgtgtacagagttcacatgccacgagcactgcttatccgcgcttggtaaccgttgacgttgcatcgctggtaatgtacacgctgcatcccagcacggccgcctggaatagaagcattttcaggctgaccagctgctagctgatggtaaacaatggcaagtgaggggctactgctgcttcctgccgcgtcgctccagtctgcttctgatggtcgatgttgaagtacatgtctctgccgaactatctacttgcctgggcctgcctgttcatgacgtcatggtagtatagaaggacacacatcggctgtccgactatactgaagaaccaaaatatcatgttgcccaccattacatgcttgaacgtagcatggagatatcttgtcaagaataccaacggtatctgaaacatgatcccagaaaatgcccagaatttgaaaatgtggcacggcaccgcaatacatatctcatggaatacagctgaaaccagaaacgagattagaatagcta

SEQ ID NO: 16081 - DNA, 488 bp, Zea mays
  Clone ID: LIB3279-228-Q6-N6-E4
gtaaaatagcatcactattaaagaaatattattgttaaagtactaaaattcaaaatacaactccatttagaacttatattggagatgctctaacagcaacttaatgcaaatagacggcggcgaccttccatcggttgtgcgtgcgctccgtcgtgaacaacagaaaaccaaccttgtagaacccatagacatcaacaacgacgacgtactagacctgtgggggccaaaagaacgttttgtccacctgctgagcgtcacatgcttgggcttgtcgatgagcaagcccatcacctcgcgcgtgagggtcttgagccctgtcgtcccgagctctagtcgagagagcatctccatcgtgatttgcctgaagtcaacaacattggccactagaatgttgcagtcatggcgcgaacgtttgacgtagccgcaccaatcggatggtcttcttgaaataatacttattataatatgatgtcctaatactagcatat

SEQ ID NO: 16082 - DNA, 578 bp, Zea mays
  Clone ID: LIB3279-228-Q6-N6-E5
gaatcaaagtaccatcgactgtccttgtggagttaacaacagagtacgatgacagccataatcaagaacaaaagatgtccacgcttcgtacaaggatcgtctattaccgattgatgacatgaataacacgagctccgaaagcgtttcacagcctcgcgatcacggcttcgacctcggcaggggtgtagaggtggtacttgggagcaaccttggcaatatcgacgttgtttggggtcaccttctcctccataacctgcttcaggatagaaagggctatggtctccgcctcctcaagggccagctccttgttgtactgctcatgcaaggagctatcagctccttcagagccagatccaattgccttcgcgttgcattgccaaaaagtgccagatgggtcggtgtagtacaggctaggtccgttctcatcgtgtccagcaattaggagagagactccaaatggccgtgacattgactcttcgtcaccttcgccaaagcgcagagctaagtcacagatagcttgtgtcgaagattctacggtcattggctccccgtatgagaacctatgattctgagtttca

SEQ ID NO: 16083 - DNA, 559 bp, Zea mays
  Clone ID: LIB3279-228-Q6-N6-E6
gggaagcattataagtaaaattttcaaagaaaaagggatttgcaaaccaaagggtagaaaccagaagcaaatttgacgtcatcatgatagtaataggatcagatatcacttgggaaattcacaacggtaaacaagtagaaatcttagcacccaacctttagagatcctagagcataacccaaaaatgctggagtactgtctcggctacacagccaatatagtggaccccagtatgcctgacaagcgaccgatcatgcttcagtctgctccctcaagcgacggatcgtgctcctgacagtgaccgcactagcagtgttcatggtgtaagcaccaccggccttgaccttcccacagtccttgcatccccaaatcccaaccgctttccttttcacagcaaacttcccacaaaactcacaaaaatacttggagtgctgagatacctccatcttcttgatttgcttacgcaagctagcaccatacctggttccatatttgccaacaattccggccttcttggttcgcttcgtcatctccccacgcgtccgcggacgcgtgggtc

SEQ ID NO: 16084 - DNA, 555 bp, Zea mays
  Clone ID: LIB3279-228-Q6-N6-E7
aaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacggagctggatggaaagcatcttcttgaagttggccggcagagacgcgccgtgcttgtcccccacatacttggcgatcgcttgcg

SEQ ID NO: 16085 - DNA, 570 bp, Zea mays
  Clone ID: LIB3279-228-Q6-N6-E8
aagaacgaacaataaatcaatagcagtagacccgtaagtccacaacgaacgaatgcgcatcgcagcattagcaatgtccactacaaagtatgtgaaactgttaatttatcatattcttgccgtgggcatcagggcctttatcatatccgatggagtaggaacctaggaggtcgaccccgatgaagccgggcctccgcacatcctcttctggaggtgctccaggctcaccacccgctgcagcgagtcagtgctgcccatcttgccggcgacctgagccccgttgacgaaatcgtcgtcctcttgagccgaggaagctatatctggcatgtaaccgtcgctgcctccgatctcgcttggaatggcgaagtaactgttcaggtcatcttggatgggtacggcggcatcagaggcggagtcggatggggagccattgaatggcatgctgagggacgacatatcagacacggcagggaacaatgtgttcatgccagttacccgcttcactgagtcctctgccatcttcacctttgctcttaaggtttcaacatctgccttaagcaccctattgtc

SEQ ID NO: 16086 - DNA, 624 bp, Zea mays
  Clone ID: LIB3279-228-Q6-N6-E9
gcgatctagctagagtgctgtgttttgaacggatgctcatgcatcattatcttgcccgtgccactgtggcatctaatcgaatcaacaactaagaactagaatctccgttcttgcctgtcagtaacagctaggaacctctgtttttcctgtgcagtaacaaccttctttcttccctgtacactaataacctttcttcacggattgtccttccccgaacgcttcgtcagttggtttgcttaaaaaatccgagttcaagccaggcaagagtgcttcgcatgtcatgcaatactccttgaccagagcaagagctggttgcatatctctgtaggtagtagcatcctccaaagcctttccttcattgcctgtgtacagaaagcaaaggctcctctttgcatacaaggttgaattatcaggatcaatttccattgccatagtatagagatccaatgcatgagaataatcccttttacagaatgtggcatccccttctgcttcataatctggttcattgtcatcatggagcacttcttcttcaacttctgcttcataatctggttcattgtcttcatggagcacttctgcttcataatctggttcattgtcttcatgaagcacttctgcttc

SEQ ID NO: 16087 - DNA, 593 bp, Zea mays
  Clone ID: LIB3279-228-Q6-N6-F1
gacgataatcaatttgctctaggatagtagtggtcggtcggttgtctcttgcctgtagagagagctagccaactcgatccaggccaccgactaaatttacatggaaacaatacaacatatcgaacacaagaggagaagcggcacgtgcgagaggagaagcggcacatggagagctagccatcatgtgggtcggaggagcgaggacgacgaagacgatcgacgagaagccagagagtgcggtgcgagctaatgtgattctgatgaggaggataagcttagcttgcttaagcccctagtgctactagtaccctactacccagtgaagcttaggcttagcagagaccaccatacgtgcgcgtgtagctagtacattttgatatgggagagctagccacatgatctcagatctagggaggagacaggcaggtgaaaggaagagaaaggtacacacacatgtagagcgagcgagagagagagagagagagaggttgagatataccctagctaattgagctcggctcccggcggccagccggtggagagaacagatgggccggggggcgcgggcgcgcgcggtcgtcgttgtcggcgat

SEQ ID NO: 16088 - DNA, 581 bp, Zea mays
  Clone ID: LIB3279-228-Q6-N6-F10
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcgcctcctccgtgg

SEQ ID NO: 16089 - DNA, 603 bp, Zea mays
  Clone ID: LIB3279-228-Q6-N6-F11
ataacaatcttatgtcgtcattaatcaccgaaaccacttaggattcagatgctttcagttagtgtaacagatatttatcttgaaatgacaggtgttgctttattcatagtgtaggatactactaaaaaaacagggcacgctaagaaaaaaaatcctttaatcggtgaatccaatttgtggagctatcattcaaccccaataacttttccttgccaaccttcgaaaatggtcacgcaaagaaacatgaccccttcctgttcagtcacctccatccacaactactcgagtgagataccctttggcgggtcaaactttgccccaagattgctcaatttggcatgagcctcggcgtagtcctcgaaaaatgcgtcctgatccttggcatattttgtagcatagatcttgaatgaggaatcctcaaacagcacagcatcagtaggcagaattaggaggtcttcatctcgcctttcttcgatagccttgaaatagctgttgtcaaacttgagccattgagatgtccaagattgtcccccaggtgcaccaggaccatctttagtgtactttgtttctgatttaccccagccactacgctctggtcttgca

SEQ ID NO: 16090 - DNA, 575 bp, Zea mays
  Clone ID: LIB3279-228-Q6-N6-F12
accacacacaaaacatggatacatcacatgcatgtagcattattcatgcctcaagaacatcaccaccgcaccaccgctagctacaaccagtcacaaacggctaaataaattaaacaccaagtctccacaaacagatactgacctaatagtaaagcaaacaccaccaaatgaaacagatccaactctccaatgcaggcaggtaattaaactaaaaagcagtagaacacaagctatatatatagctagctagacgtacggtacgtgcaaggcccaactactgctcgtatggagctaggggaaaccacgaaccacgcatgcatgaagacgacgacgtactacagtaccatcactctactaccacgcacgctggctagcccgacctcgctccagcgacggatcggacggacagacggagttcagggcttgttggcgtgctcggggacggagccggcggtgggggacccgggcatgccgccgaagccgctgaagcccggggagccgccgccgaagagggcatgctgccgctgccgggcaagctgaacccgggaaggctgctgccgctgccgggcatgctg

SEQ ID NO: 16091 - DNA, 377 bp, Zea mays
  Clone ID: LIB3279-228-Q6-N6-F2
aaaggaatatgtagtagattaaagaaaatgataactgttgatctctcgtctccgcagcttacaatagtgcttatatatcccgtctctaattggatataaaactaacttattctaaataataggaaaagattacaacaaactcctattttgtggccgccaactccaaggatttgcatgatgacctgacaaatatcttggttatgtattcctgcttatttctcacgtattctctggatgataatttctttttctttcttttctttctcctgcagatgcgtcttgaacttttggctacagacgtcctttttattaccgatgacttctgaatccttggtccaggggcggagccagcccttattttggggtcagctgacccc

SEQ ID NO: 16092 - DNA, 362 bp, Zea mays
  Clone ID: LIB3279-228-Q6-N6-F3
gccagtcaaaccaatctagccatttataaggcaacagaggaatacatcgtacttccgagccacaacaaatgtccatacaaaccaaaaattaaaacacagccgatgatatgcaaagcacagcatctcacagttctgacctatgccttgatagcatacttcctcatggggaagtacttctcacgcttcttttccctctccgtcttcagagaaagctggtgcttggtcagacggcggcggatggcacgggtcttcttagggcggaggtcgagggggagcaggttcttcttcttgtacgcctcccgcaacgccgacttctgcttctgcgagatcactgtgagcacgcgcgcgatagaggtgcgcac

SEQ ID NO: 16093 - DNA, 594 bp, Zea mays
  Clone ID: LIB3279-228-Q6-N6-F4
caaatcaaaaaaagctgaaataaattcttcactccaatctaatccgaataccagatcttaataagaagagtaccagatcttaataagaagagcatgccggtgacattgttttggcaatcagtgtcatggctgctacgacagacttatttcgaaacataggacagtgcttattcaacattgttatacaatcaagaccctaactctttcggggttttcgcaacaatggagacagcatggaggcctgagctaagctcatccctcagaagatcatacaccatcctgtgacgcttcacaaggttctgcccctcaaattttggtgaaacaaccttgatgttgaagtgcgtctcgttcgcattgtccttgacggctgcatgcccggcatgttggtaagaaacgtcttcaatatctagggcactggcctccaaggcagactgcagtttttgcctcatccgagcagcccttgaaagcacggcactggtgcctcgtgaagccatcatccatatagtgctcgcagcccagttattatacgttgaaaccagagaccgtgttgtgtcgaggcgatgtgagctcctcaacagtggcggcggctgggct

SEQ ID NO: 16094 - DNA, 593 bp, Zea mays
  Clone ID: LIB3279-228-Q6-N6-F5
gcctctacaaactctctgcataccgatagatggtgaccaattccagacctgaattatggacagaacgaagacagcacctgatgctaaacaccataagtacaatttgaccaacaaaggaacacttttgccagttgtcatcttcatcaaaagcattggctaatctgactcattgcatcaggtgaaaaaaaaagattagatgtgcacaagcgcactgtcagaaatgtaatgcagcttgatgtagtaaaggcaacttgtggcatggttcaagcaggaagacatcaggtgtgttactgcttggccttctcttcgttttggttcgccaggctttgtacttggatgctttgttttttcccaacttctcttaatgaaatacatgcaatgaacattcttggaaaccttactcctcggacaacttctgtagctgataaacagctagaaagaagcatctctaaccttttggtacaccctcctgtatatcgttgctccttcaagctctgcatggatttctcgctctgtccggattcccattgggttgtccagaaagccatccttcattgtcacactgaagatcttgatcgacataattaacacgt

SEQ ID NO: 16095 - DNA, 425 bp, Zea mays
  Clone ID: LIB3279-228-Q6-N6-F6
ggcccggcccacaaggggaaagggacagctaaaagggagccaaggaaaagttatctagcaaatattagctatgaactattattaaccagctaactattactcttttagcttccccccaaaacgaaagctggtctagcggcaaacatctaaacatgatctatatctaaggcatatagggaaaaaaacaatgtacgtaaacaaaaacaaggatgggttgaaatccggaacggggtttccaacatccccaatgcttcaacccttggaaggcacgggaaaccctttgcatactggacaccagtttttttgcccaaaccactggcctatgcaaaacaaatgggaccggggctcgcatgggagcctcccaacctttttgccctccggggacccttcctgacaaaggctgcatttcatgtcatcaacggggg

SEQ ID NO: 16096 - DNA, 417 bp, Zea mays
  Clone ID: LIB3279-228-Q6-N6-F7
cgttccaacacattctcattgcattgcaagcatcaccgaagcaacagaatgatggcaaatcatgccttatacagcaacaaaggagacgtccatagttgcagaacacaaatttcacggcaaaaatattggccggatcagaagagaagcctcggaagaatacagggtgtgtagacaccgaaccacgcactggttaacaattaagtgtgcctataacagtccctctcatgacgtgcctcagttttgcactagttgaagtcaggcttctccgggtaagtacagcccgggcgctggatgataacgtttgcggcatagcaacctgcccttacgcagtcttcaatgcccttgcctagaaccaactgtgagaggaagcctccaacgaaagcatcacctgcgccgttggtgtcaacaagcttctcc

SEQ ID NO: 16097 - DNA, 580 bp, Zea mays
  Clone ID: LIB3279-228-Q6-N6-F8
aacacacaacacattcaatgaagattcagggtgcaaaacttcatttagccaaaagacaacccacactcagtgcaaatgtcaggcattggaatttgatacacagcatgacctgctttcagaactactagtaacattgaaatttgacgagtttttagaacagtagtagacccacagcttcgatccaacatcgagatgggtgatgagaaacttagaagagagatgttcccttgcccttcttgtctccaccaatctcaaaatgcttgcacctcttaattgcgtgctgtgagtagtgcttgcagctctggcactgcagcttcaacacgattttcttggtggtcttggccttcttgtggaagacaggcttggtctggccaccatatcctgactgcttgcggtcataacggcgctttccctgggcagacaggctatccttacccttcttgtactgagtaaccttgtggagagtgtgcttcttgcactccttgttcttgcagtaggtcttcttggtcttaggaacgttcaccattttggcggcggcggaaagggctcgtgcggcgtgctccctgctccggtaggtaga

SEQ ID NO: 16098 - DNA, 588 bp, Zea mays
  Clone ID: LIB3279-228-Q6-N6-F9
actgggctcgaattattttggaagttgctcatttaacagagcgctaagcagatgacccaaaaatttcctcaatgaaacatttcgcagttcatgaaatcaacagactgcaacgaccaaaagatgccggtaaccccaacagttttgttttccccagctgacctgatatgacccaaacagtcatgctaggaccttagaagaaaaaatagtcttgataatcaatcagggcttgagggccacagcaattccaaccttcgagctcttctcaatggtctttgtatcgacctcagccgagatggtgaccagcgactttggcctccactcatgctggatcagggcgctggctttgcccgagttgttgatgcgtgccttcaagacggttagtgggtccagagtgtgctgcccgccaaaggtgagggtgttttcattggtcgagaaactgtgggtaagctctgccccaacagctgtgtttgtcaattcgctcaccttgtggtagtaagctccagtaaggttgtctcccttgttgttcatattaagggatgcgataaggtcttcatgagtgaacatcaatccagcattgtatttggtgaa

SEQ ID NO: 16099 - DNA, 606 bp, Zea mays
  Clone ID: LIB3279-228-Q6-N6-G1
aaataaatattccctccgtcgtttcaaaaataaactaacaggtaacaaatatttgagaacaaatattcgagaacagagataatgaaccaatattcgagaacagtgataatattatacaagacgttttgatactacaagacaaattaagtgcacaagcctctccacaagagatgacgccgtgagaactaccctccccaagcagcaaccagtgaaatgacgctccaaatctgtcccgactcctgagtatgagtggtgctcttcacgtaagaatgatgctgctacccagagccagttgtatgaggtactcatttcagcttcagttctttgtactgaagaagaaaccatttctgtcaggctttatctgctttgtcgtgctcatctgaaagctccctttgcttccgataatggaaataaaggaactgaagaatgataaaagaatccagcaaaacacatcctccagcgtctacgagccacgggagatttggtccaactttcgaccagtccaagctatttacaagtatgcttcctacatatgttgaatttcccagtaaagcaaaggtaaacattaatggattcaacccctcagcgtggcctctttgcatgttt

SEQ ID NO: 16100 - DNA, 187 bp, Zea mays
  unsure (1)..(187): unsure at all n locations; Clone ID: LIB3279-228-Q6-N6-G10
acaggaaaaaatcttttttacaacaggcaaaagggttatctgattcccagcactgcgaaacaaaacaagtttagcataccacaaccacaagcaagccacnncaatgtgaaattccggaggttcaaaactattcccagaaataccaagggggagcaaatctgccatgtaacattacaaagtttacaag

SEQ ID NO: 16101 - DNA, 571 bp, Zea mays
  Clone ID: LIB3279-228-Q6-N6-G11
ggatcgaatgtcacatctttactatataataggagttatgtacaaaataaataaataattacattataaggagacaacggtccagcaacccaaagttgactgggagacgacggcctagatctcttacaaacatatcgcagcaacctccatgcgcctcatcctgcggtacctgttcttgacctgggacttgagattccaagtaccaacttgctcttcagatgacacgtgtcctcaccgcaacgtcaagggtgcgaaggatgctgcccacgcgcgcaggtcgaaccatggcgggtatgctattccggcgagcaattcagtcggatcacggagcccaatcctcccgtagatgccacagtaatctccgccaggataggatgggtcacccagacccctcacaggaccccgaacggtggttcataccgccggccacgacagcgacatggatctcccctccgtggcactgcttttctcgatttcctgcgcttggtggcgtggtcaggaggatatgaaggggaagaacggaaccccgacttcatttatatagcgccagaaggtcgttttttgaatcaca

SEQ ID NO: 16102 - DNA, 572 bp, Zea mays
  Clone ID: LIB3279-228-Q6-N6-G12
gtcacagtcctgaattaagcatttcaaacacgatcaaccaacacgataaaataaccacagctcaaactccagagagaacatacccacaaacacacaacatcacaattgatcggggtagctgtcctttgttcccattttggtagccaggcactgagccggatttgaaccattgggccatcccaaacactaggcgaagctgaacaaaatggtaccttccgtgctcaggctcggctctggagatctcaatgcttctgaagcatgtccctgaaccagtaggccgacgccttcgggtggcgttcgagcgtgttgaagtccacgtagacgatgccgaacttggacgagtaccctgccagccactcgaagttgtcgaggagagaccaggcgaagtagccagccacgttcgctccctggtctatggccttcttcagctggccgatgtagctcctgtagaaccgcaccctcgtggcgtcgcgcaggtactggtctcgggtcaagtttccaggctggtccattccgttctccgttatgtagatcgttggattcccatacttctccttgaggtagttcacgca

SEQ ID NO: 16103 - DNA, 554 bp, Zea mays
  Clone ID: LIB3279-228-Q6-N6-G2
cacgaagaaacgaacattgagcttgatttacggggaagttcaaccatatccaaattcccacggagaacgggcttttcatgttccactcattgtatctcgtacatagtaatggaagcttgcaaacattattattcacctcgaccaagtaatacaatctaaccttctacagcttggcaggcttggggaagatgtcaggggtgaacttctgcgccgcactgatgctccccttgattttaatcgcccctcggatgaatgcaatctggggattcgtcttgccgggggcgattccaaggaaatcgttgtccgtgaaggaaaaaggggcatccggctttccctggtacggccctttggggacctcgcccttcttggaggtcgaccacaaagatctcctcatcaacgccgatctttttgggggcgatgttgagctggtaaacaaggccaaccttcttggtgagctccttgccggcgtcggtggccaggtgctggcgcatcagctccaggagctgcgcggatttgaggctgctactgtccatctcagcggacgagctgggact

SEQ ID NO: 16104 - DNA, 552 bp, Zea mays
  Clone ID: LIB3279-228-Q6-N6-G3
ttttttttttttttttttttttttttttttttttttttttttttttttttttttttttttttttttttttttttttttttttttttttttttttttttttttttttttttttttttttgggaaaaaacccggggtttttaaaaaaaaaaaacggggggtttaatttaattcccccccaggttttactttacccggttaaagccctgggtttaaaaaaaaaaaaaaaatggttttaaaaccccccccccttaaaacccccggggggggggtaaaaaattcggggggggggggggaaaattttaggggggggaaaccaaacccccctaaaaaaaaacatttgggttaccccggcgaccccccaggggcaaaaccctaaaaaaaaaaaattttgagggggattcgggggggcacggccccccccggacccggggggccccccggaaattccgggccgggcccggggggggaaccaattttccctaaaggggggggaaaaaaagctgggggaaaaaaagggaaaaaggggtcccgggggaaaaatggtaccccctc

SEQ ID NO: 16105 - DNA, 300 bp, Zea mays
  Clone ID: LIB3279-228-Q6-N6-G4
tcgcgatctagaacctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtcccctatgaccgaaaagcataactgtgatgccctatggatgtctacacgttttttttgttgattgtgcat

SEQ ID NO: 16106 - DNA, 588 bp, Zea mays
  unsure (1)..(588): unsure at all n locations; Clone ID: LIB3279-228-Q6-N6-G5
cctcctccttccgtgccaactcctctgccttcctagctaactccaattgttcctccaatagacgagctttctctttcaaagtctgttccaaagcctctgcctccgatactataacagagttgttctcggtctgggcacagatatcagatgcttttgacttggtgcgcttgctggtctggggggcttccaaaacaggaaaggagtcctctttggcagagactgcagctggagcagctaccacaggtgctggtattgaagctaaagtggccactcccgggcttgaggcagacaatggatagatgctgcttggtcttctgcttgatatgactggagggtcctcatcagggccaagtttccgtccatcatgggtccctaatctctttagtgtgctaaccttatttgactcaacatactgcttgcggaattcctcgtttttgttccacatttccatgactccctcaatctgactattacagtgtgatttaagtccatttatatcgccattagctctgaaaatttctgctgcattccggtcatccctgntacctgaagaatattcattcttcttggagggctctgatctaagct

SEQ ID NO: 16107 - DNA, 349 bp, Zea mays
  Clone ID: LIB3279-228-Q6-N6-G6
accctaaaataaaaaagatctattatacacaaaattatacaaagatatgtgttaatgtataacatgacgccttgcttttttttaaggatggatgaaaatgagaaaaaaacttacaaaaaaacacaatttttttagaactaacgtaacaacaacttctgaaattttgccaaaactcagtatatttccttgaattgaccttaacacgcaggagaccaccttcaacagtcaaaaaacatttgggaggagttgacatgagcaccaataagtttgtttggagaaagagtgtgctacagtaggaacattctcagcacctttattgctgcttagagaccaaccatcacatgcaatc

SEQ ID NO: 16108 - DNA, 425 bp, Zea mays
  Clone ID: LIB3279-228-Q6-N6-G8
gggcggggggggggccgggggagggcggggcccgggggggggggggcccccgctcaccctgccgggggcatgggggggggggggcagaagggggggaacctggggggcccggggggggaggggactaacattaaaggggaagaactaacagaccgggggccaggggggaaaacgggggggccggcggggggagggaaaaggccaacccacggggagagggggggcgggcattgggcgcccgggggggcttggggaaccccggggagacgggaaacagaagaaggccccgcacgggcggggggggggagagtcccaggaggcggtacaagtgtttttgcccaaacaggaaaaaaccctgtcccaggggcgccccggcccggaaaaaacatgaaaaggctgcaaaaacggggtatccccgtacggaa

SEQ ID NO: 16109 - DNA, 573 bp, Zea mays
  Clone ID: LIB3279-228-Q6-N6-G9
catcaggaaaatcgtgcccataggccatagctgatatgattatttaccgtatttctactgaaacggaacgataaaatggaacctgaagtcggcagagagattcagatttatttttttacaaaaaaaactatcatgatttgcaaacgcacagcccttcaggtcccaatggacaaaatcttaataacattaatcgaattccagaaccaccttgccaggagccaactttttctccttggccgcatgagcttctcttacatggctgatgggaaaggtcttctccacaggtatctgtagtttcccagctccagatagcctttggatctcgtgaaggccttcggcgtcagctctcatgtatgtccaccaatactctattccatgagaataacgatactgcatctgtttctttagtaaaacagcagtagcagcaggaagccctacagccaatccatacctatctgctagggcagctgcttctccctgaagggtcatatagtgtccacctctcctaagaaattgatgccaattctttctgtctcaggtactcctatggtgtctaaaacagcatcaaacttt

SEQ ID NO: 16110 - DNA, 586 bp, Zea mays
  Clone ID: LIB3279-228-Q6-N6-H1
ggctaatatcagaaatcatataatgtgactgattcaacacaatgaagtactgggtagaactgaaaccatagtactttgggcagtagcagagaacccaatcacatgcatgatccaacataacaaagtagatactagtaatagctagaacgaacaacaaaggttgatactagtagctacaacggacaccattgtaggcacccggccgatcacatcaagacttgagctagggcagtagtaagagcactgtggcagagatccaatcacttggagacttgaggctagtgactgcaaatctcgatcgtgtagacacgtaggtagctaggtgacgatggctaataaggagtggaagcagcagagaccatggcatcgatgtccgacttgacgttgctgaagacgctgtccatcagcacgaagatcaccactgataagttgctcccgaggccgtggccggcgagcgcctcgccgtcgacaccggtgaggtccaccttcctggcgaacaccatgcttctgtcaacaggggcgccgccgaaagcgctcgacaccatcttgcgcacgatctccagcttctcgatgatctgcagcgcca

SEQ ID NO: 16111 - DNA, 238 bp, Zea mays
  Clone ID: LIB3279-228-Q6-N6-H10
aagaagcatgaaacgggaatttcagttctcatagcattatcatgaatctcagaacataacaggggaaacacgaatcaagcagaggccgccatggggttcacagatccacacctaaaccgctaaattaaactgcgagcgatacatgataaactaagaccaccactcagatcaccaccatcttattcagatccaaaggaacggacccagggggagtcgacgatgacggagggagggcggc

SEQ ID NO: 16112 - DNA, 559 bp, Zea mays
  Clone ID: LIB3279-228-Q6-N6-H11
aagcgaaacaaaccacatgatgagcataaattaacatcagagccacttaaatagagcacgtttctctattactaaagcagataggtgtacaagaaacctgagtctataggcagactttttttttgaataaccaagcatcaaatgtcattgtattccgacaagtcaaaaaactcatggcgacattactctcacgagcgatcttcgaaaccatctccttattcatgtgatcttagcgctgggaagtgaacaatgcgcggctgacaataccagtggcctcaatgtagcggtcaacacaacgtgatatgcagctgctctcgcttccactcaagcttgatcctggcttggtcacgcacttttcaaagcacttgttcccgacggtctcgagaaactcctgcgcgtaagcctgtgcgagctgcgtcttgatctgttccataacaacgtccgggttagcgccgggacctgacgacgacggcgaggacgagaaggaatccatggcaggccgcttcgccttgcttgctccccaagtcctgcgctgcgcgggtgggtcggtggctggctg

SEQ ID NO: 16113 - DNA, 591 bp, Zea mays; identical to SEQ ID NO: 15925
  Clone ID: LIB3279-228-Q6-N6-H12

SEQ ID NO: 16114 - DNA, 614 bp, Zea mays
  unsure (1)..(614): unsure at all n locations; Clone ID: LIB3279-228-Q6-N6-H2
atgagaaaagattcttaatacatttgtgatcatatccatacataaattttgttattttaatctagttgtttcaccactacattacaaccatcagtaccatacagacttttatatatgatatttaggtacacatgtgttactacgatttttaaatgaattaccttgtaattgattcaaaagatccatagcgatagtacgcaagcttaccaaagtttaagagaacttacccgacaaccagctgcccgtattttcttggaagaacagaatggttggacttgcatcttgtggagaaatgctatggcagctctctgtagcagcatgtggtcttcagcagagagagaaaatttggtgctacacttcagcaggtcatgcatttctcctacaaagtgtgaccttatcaatatctttagccaatacggtcatgtcaatgaagtgaagacagatgttgcaaacagtgccagctctgcccaggtgatcttcaagaggcgcatggatgctgaggcagcgtttgcaggtgctgggaagatcagtacccttggacctgcccttgtgagctttcgtatcactgacttcccagctagtgcttcaggaaataaagcttnccatgttgcatc

SEQ ID NO: 16115 - DNA, 512 bp, Zea mays
  Clone ID: LIB3279-228-Q6-N6-H3
gcgcatgaacacgaaagctttattgactcggaggaccagtgcgcaacgcaacgacacgttgtcgggatgcacgacggccgcaggcagcaaacattagccagagacaaggacacggaccggggtacgtagctagctagcaagcaaattaaggaaccaggaggcaccagcaccacaccacaccagcgacgtgcactagtaaactgggacccgtcgatgaatggactggaactgtactgtactggaccatctccaggtggcgctccatctagttcttgaggagggagtcgtcgaggtcgtggaacgtcttgggggcggtctccttgatgacgtccgggtcaggcacctggtcgttggccttgtcgaactccatggcccaactgacgacggggccgcccttgcccttcggcttgggcggagtcaccttcagcgtgatcttgaagttcttgtaaaagtccgccagcttgccgtccaccacgctgtacgacaccaccttgttctcgtcgtccgccgtc

SEQ ID NO: 16116 - DNA, 508 bp, Zea mays
  Clone ID: LIB3279-228-Q6-N6-H4
ggcatccatcacagaatatgtcatcattattatcaggggaccatctgtatcatagctagcagatgggaggttgaaacatctttcgatcaagcaaccaactgcaacatcgcggaacacagaacacaagaggtaccactgttacaatcacacttagtgaagcgcaacacagatagacagctgccttatcatcctctaggtattggagacgggtgaccagtctcatttctttccacttttcttcagacccgagcccccaatcgcgcccttctgtgccttggccttaagctccttcagtgctttttcctcatctttcttcttctgcagatatgcaagatccgtctcgtcgtactccttcttgtcggccttgggcgccttcagcggcttggccttccctccttgcttcgacatggccggcgggggcggataagcacgccgggaccgaaaccctaaactggctggcgagagccgcgagagtaggtggggaaaggcacgcggaaccgggtgcgcg

SEQ ID NO: 16117 - DNA, 392 bp, Zea mays
  Clone ID: LIB3279-228-Q6-N6-H5
gggaaaaagggggaaaaaggggccccttaaaaaaattttaaaccagtttagaaacagaaaaaaaacccccagggggaaaaaaccccgggggggtttaagggggaccccaaatttggggggaaaaaaaaccttgggggcaaaaaaaaaaacaaaaaaaaacccccccccccccggggggaaaaggaatacccccggccccccccaaaaaaaaaaaaaaaccccccaaaaggggcgggttggggaaaagaaaaaaacgggcccggggggggaaaaccttttgggaggacccccaaatttggaaactttgaaaaaaaaaaaaaaaaggggggggggggggtgttttttcccccaaaaacccccaaggggggcccccccggatattttttgccccc

SEQ ID NO: 16118 - DNA, 435 bp, Zea mays
  Clone ID: LIB3279-228-Q6-N6-H6
actgggaaaattacaccaaaaattttatttcgggattcaggcatgacaatcttcctaagtcacagactatactggcaaaccatttttgagagagagagagagagagagagagagagaggtccagaactcatctgccttggttcatcacaatgtaagctagggtgtttgcttccctcccctcaccttttttacaggtggtgagacctgggttttccgttccatctcaagtatctccaagcaagcatgcgggtgagttttttacaaattcaactcgcacaggcgcactacacctcctccgggcgtataaacgaggggtcctcctccatttacccaatgacaaacaacacattttgggttcaactccatcccacttttggcaggcgtgcgtaggaaaaaactggtctcccccaaaccgccaaaccccggacagggaca

SEQ ID NO: 16119 - DNA, 449 bp, Zea mays
  Clone ID: LIB3279-228-Q6-N6-H7
aaaaaaaaaaaagcaaaaaaaaaaaaataacgggaaaaaaggggcgaaacgagggccgccccccaaaccgcgcaaaaagggggggcggggaaaaaaaacccccaaaaccgcccccgggccgaaaagccccttttgttggggacccccaaaaaaagtttttcccccgggcccgggggggggggggcccctcaacgcccccaaaaggaggggggggggccccccggggtttggggggggaaaaaccaccaagggggggaaggggtttttggggccccccccccgttttgggggaggggagcccgcgaaaacttttaaaaaaaaaatttgggccccgcggggggttcccgggaaaaaaaacccccaagtttgttttacccccccccccttttgcaccccctgggaacccggttttaaaaaacccctggagggtttgcgaaacacccgggggg

SEQ ID NO: 16120 - DNA, 404 bp, Zea mays
  Clone ID: LIB3279-228-Q6-N6-H8
aatagtaaatcaatcactcaatagtataaatgttccgtacagaaaagatgtcacatcgccgttgttcatatacacctccaagaaaattctgttacaagtgccgtatctggaaaatccctattgaattatacgcctatcaaaatgtttgctgctctgtcactcccacggccacagatggcaggccaccggccggcctcgtcccaaaaatgaaagaaaatggagaagatgttggtagttctttctttcctttgcctttacagtgtacaatagtttattcaacttacaatgctacaccaaacctgctgctcacaccgcaaaaaaagagtcatctatccctacctcaagaaactagttcatgtaggcaacaggggttgcctctccggacgcgtgggcggacgcgtggg

SEQ ID NO: 16121 - DNA, 422 bp, Zea mays
  Clone ID: LIB3279-228-Q6-N6-H9
gggaaaccttcccggggtggggccccccagggaaaaaacgggggagccccccgggttttttttcaaacaagaggtccccacgaaaaacaggggcgggggccgacctattttaacatttttgggcaacaccgggcataggggacccccctaaaattttatggggaaaatattgggaaaaagcggggggggccaaaaacccttccgaaaaacaacttattcggggggaaatgggcccaaagaaacaaattggcccttagttaaatttttggcccctgccgcccgggggggttggcccggggcaacatttaaattttttggtttgacaggggggttcttttttcctgggaagcccttgggcttcaaaacaaacaaagccgggtttattaaagggttaaaaactgtttgaacatcaacgggccccg

SEQ ID NO: 16122 - DNA, 316 bp, Zea mays
  Clone ID: LIB3279-229-Q6-K6-A10
gacaaacccatctttgaaagccctcatgcggtgagtggagtcatcggccttgcgctcctgaccattcagtccgtcctgccaaaactgttcgagggaaacccagggcttaggactacacatggtctgctcggcagtggcatcatgactctgtttctaatccacgcggcacttggcctgcggggggggatcagtttctaacttgtggctacaatatcttggggtttgcttctctttttctttaactcactctaagtattatcacacgaagcatccccttaaatcaaaataatgtaagagaaagcaaaattattttcct

SEQ ID NO: 16123 - DNA, 400 bp, Zea mays
  Clone ID: LIB3279-229-Q6-K6-A11
gaaaccggcggtgattaatgttatcagggatccgtacgccggcgcagagagcggtcgaatgcagcacaagaactgaaggcgcttgcttggcttttgtaccataccatagcaggatgcagatgcgacttgatacaaataagcagcaaccgtcaatcaatccttttgtttcttccttacgagggggcttcgttgttcgtggtacagatgtggggcgcttttaattggaagtcccatttgaaggcatgtgaatgtgttatgattatctaaatgccacgatgcaaactttaaaggcatgttgatgatgatgtgtggaaaacctgtgcccatatatactgtaataaagtcagcgttttaggatctgtttggaagcaccgcagtttctaatatactggtttttaat

SEQ ID NO: 16124 - DNA, 658 bp, Zea mays
  Clone ID: LIB3279-229-Q6-K6-A12
cccaattctcctcaatcaaagaaagtgcggacgcggagcaagccaagatctgcgccgcggcgaggcgaggcgaagcaaagcaccggctggctcccatggccgtggacctgatggggtgctacgccccgcgccgcgccaacgaccagctcgccatccaggaggcggcggcggcggggctcgcggggctggagctcttcgtgtcgtcgctgtccacgcaggccgccgcgccgcacagggccgcggctcaccagctgcagaagccgccttcgcagccgccgatcggcgagatcgccgaccaggccgtctccaggttccgcaaggtcatctccatcctggaccgcaccggccacgcccgcttccgccgcgggcccgtcgtcgagccgccaccggtgcctgctccggccgtcgccgctcccgctccggcccccgctctccacgtggtggctcccgtcgccgtggcgcagccccagagcctgaccctggacttcaccaagccgaacctggccgtgtcgggcggcgccacgtccgtcacctccacgtccttcttctcctcggtcacggccggcgagggcagcgtgtccaagggccgcagcctggtgtcctccggcaagccgccgctgtccggccacaagcggaagccctgcgccggcgcgcactc

SEQ ID NO: 16125 - DNA, 651 bp, Zea mays
  unsure (1)..(651): unsure at all n locations; Clone ID: LIB3279-229-Q6-K6-A2
cggacgcgtgggcggacgcgtggggcatgttagtgtgtgtcggtagcccaattttttatgaggagtctatagtcaaataattaggtgaagatcaccgtatatcatacacaagtaattagatgaagatcatcatacatattgaactccctgtctactttacaattggatgttggtgaaagctgaaattacgtagaggtgtcctagtaatggaatttcaaagtttggtaaaaaactaagagtcaacatagtaaatgaaaatatttatgttggcatatattatactagtcgggtgcccgtgcgttgcaacggcatacaataactcttgaattttatgtctataatcaaatatatgataataaatttagaccatatataaatcacgtacacctgtattgtatgaatttagtaattatttaaaatgattttttaacttcggacggatggagtagtcgttaaacactgagcaaacaaatgcaataatgacagattattcacaaaactttaagatctaagacgaatctaattaaatgtgtggttataattaacttgttgcgtaacaaaatcaactaaatccaattaaataacaaccaaaatgagtactcaaataaatacacaaacgtattntacataactaagcaacagaaagttact

SEQ ID NO: 16126 - DNA, 644 bp, Zea mays
  Clone ID: LIB3279-229-Q6-K6-A3
attcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcaaatgggacgaatgtgcttgtatgtgtat

SEQ ID NO: 16127 - DNA, 582 bp, Zea mays
  Clone ID: LIB3279-229-Q6-K6-A5
actcaatcatcctcagcggaggaaagcagagcacggcacagcgagtcgcagagggatagatccgagcacaagcaggccccgatggcgacgacggcgacgaaccggcgggtgatcctcaaggagtacgtggagggatacccacgcgaggagcacatggagctgctccggggcgccgaggttcccctccgcctgacgggcgccgagccggccgggtccgtcctcgtcaggaacctctacctctcctgcgacccctacatgcggcccaagatgtcgcgcccgctgcgggagtcctacacggccgccttcgtcccgggcgacaccatcacgggctacggcgtcgcgcgcgtggtcgactcctccgacccgcgcctcgcgcccggggacctcgtctggggcatcaccggctgggaggactacagcgtcgtgacgccgcccgccaccaggctcctctccaagatctcccaccacggggccggggagggggcgggcgtgccgctgtcctactacaccggcatcctcggcatgccggggctcaccgcgtacgtgggcttccacgagatctgcgcgccgaagaagggcgag

SEQ ID NO: 16128 - DNA, 652 bp, Zea mays
  Clone ID: LIB3279-229-Q6-K6-A6
gttctagatcgcgagcggccgtcctgaatcatatgcagtgaggcgtgagtccgtgaccattcccgtcggccgtcccaaaagaagcgcaaatttacaacccagtccaccacgggccacacaatcccaaatctaaccctccgacggcgatggggatctcgagcatgccggagccgcgggacagcctgctggggtacctggtgtacaacactgtgatctcgatcgcggcgctggcggggctggtgcgggcggcgctggtgttcctggacctgcaggccgcgctgccgcccggggacgacggcggggaccgactggcggcgtcgggcccgggactggcggagcggttcctcagggccttccggccggcgctgtacgaggtgctggcgtcgacggcgacgacgtgcgaggcggacggcggcgccgacggcgacgactgcagcgtgtgcctggccgggttccgggcgagggccgtggtgaaccgcctcccctgcggccacctcttccaccgcgcctgcctcgagacctggctccggtacgagcgcgccacgtgcccgctctgccgcgcccacgtgcccctcccccgcgacgagacgccggtgctccgctacccggagttcgagtgatccggtaaaaaccaccccgggcccccaacccc

SEQ ID NO: 16129 - DNA, 527 bp, Zea mays
  Clone ID: LIB3279-229-Q6-K6-A7
cgttaccattattgataggcgatccggcaaggagctggagaaggagcccaaatttctcaagaacggtgatgctggtatggtgaagatggttcccactaagcccatggtggtggagaccttttctcagtatcctcctcttggtcgatttgctgtccgtgacatgaggcaaacggtggctgtcggagtcatcaagagtgtggagaagaaggacccaactggagccaaggtgacgaaggctgctgccaagaagaaatgatctatctggctggtgacgaaggctgctgccaagaagaaatgatctatctggctggtgctgtgcttgcttgttggttacctcgtggaagcttaaaatatctcgtcttgttgacatccttgcagttgtcgcgtgaacaagtaatctatgatggcaatgtttgcctggtcatgaagtattattactttcgttgaaaccgtgatgctattaagacttaattttttttatggaacatcgaatgtaaggcatacatggttatgagttttgtactacc

SEQ ID NO: 16130 - DNA, 651 bp, Zea mays
  Clone ID: LIB3279-229-Q6-K6-A8
cccacgcgtccgcccacgcgtccgttcagttcactggcatcctgtgtagacatgcattgtctgtgttgaagttgcaggagatatttgagatcccaaaagattatgttctcgatcgctggagaagggactataagaaattatattataatgcaaagaaacctaatgaaatgcctcttagtgacattgttgaacgctctgattatttgtttacacaatgtagtcagctgctcaatctagggtttgtatctgagagtaggtacattgttgctctgaagttactgagagaaatggaaagatctcttctggatgatggactacctgctagagacaggcagccaatgcttctttcctttgaggctgatgcaccagaaaatggtcaaggcctttttagtcctcagttttcagagggcgtaaagaattctcagtcagcccatgcaaagcgccgtggccggccactgaagaaagtgacagaatctactgatgataccgtaacacagccaaataaagaacaggatttcctacgatcatcatttgtcacagaaaatacaaatatgatccaagggccatcttctgcctcccatcttgaaggtcctcacatgggagtgcaaggaggcattgatttaatggatggaataccaaatctctcatttg

SEQ ID NO: 16131 - DNA, 658 bp, Zea mays
  unsure (1)..(658): unsure at all n locations; Clone ID: LIB3279-229-Q6-K6-A9
cggacgcgtgggcttcccaaatagctttgcctcccaagcctgagattgcagatactggtgatttactggggttaggtgattcaacccctactgtgttggcgatagaggagagcagtgctttggccttggcaattcttccgacaggtattgataactcaacaacaactacacagcaagatagtggatttgatccaacaggatgggaacttgctcttgttactacaagcagcaatgcgattccactgtctatggagagtaatttgggtggtggatttgacaagctcacattggacagcctatacgatgatggaacctacaggcagatgcagcaacaacagctatacggatcagcccctcccaatccattcatggcaagcgatcccttagccgtatcaaatcaagtggctcccccaccgtcagttcaaatggcggccatggctacacagccccagcatttgcccatgatgattgaaccaaatcccttcggaccaccacagcagcatcacgcgggcgtcgctcctgcagcaaaccccttcctcgacgccgggttcggtgcgttcccggcagtaaatggaatgcatccacagaccaaccccttcggaggcgccgcacaacttctctagtcatatatactntccaaagtttgcattacaattac

SEQ ID NO: 16132 - DNA, 338 bp, Zea mays
  Clone ID: LIB3279-229-Q6-K6-B1
cccacgcgtccgcccacgcgtccgaccgtgcgttaaggaggaagtacctgatgctggaggaagagaactttgcactggacaaagaactgagcatggaagatgaagaaatgaaggccctagaggatgaaaagcttgcactgcttgatcagcttgttgtcttggaaggccttgtcgagccatcccagttgcagtctcaacctaggccgtaaggtgttttggtttatgtataatcgttgtcgttcattataattcagctactagtagctgttatactatctgggcttaaacagtgtgtagaaacagcatagtagacctgttacttctatcggacatcgacg

SEQ ID NO: 16133 - DNA, 626 bp, Zea mays
  Clone ID: LIB3279-229-Q6-K6-B10
cgacaactcgccctcccgtctttccctctctctcctcccaccacacccggtcgtcgttgtcgcggcgtgagcgagcgagaggggaaaacccaaaaccctagcacccccgccccgtcgccgacggccgccggagtagagagatggcggtggacgaggtgaactcggtctacgtcggcgggcttgcctacgaggccaacgaggagatgcttcgcgacgccttcgggtactacggcaccatcgtctccgtcaaggtgattaatgatcatgctgtcaaaggcaagtgttatggttttgttactttcactcaccccagagctgctgagcaagcaattgcgggcatggacggcaagaaattaggcaaccgtattgttcgagtaaatgaagtgcgtacaagaggcccccgcgattttggccgagatggtttcagacgagatccaagaaggtatggtagagatccatactgggacagaagggacagggaacggagctatgatcgtgaaagagatccctaccatgacagggatagtgatagatcccgtgagcatgatatagaaagagattatgaacatggtggatttaatagagaaattgactatcccatggaccgagatcgtgaaggagatgag

SEQ ID NO: 16134 - DNA, 589 bp, Zea mays
  Clone ID: LIB3279-229-Q6-K6-B11
cggacgcgtggggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtag

SEQ ID NO: 16135 - DNA, 253 bp, Zea mays
  Clone ID: LIB3279-229-Q6-K6-B12
ggacgcgtgattttagggatctgtttgtatggcagtaatgaagtcgatgccagatttgagcgtaaaaatcttcacgtttgagcgtaaaatagtgtcagacgtagcataaaatcttgttttcatcacctcgcatgcgaggtcctatttttatggaagatatagtcttcacccaccagatgtggatgtggttttcgatttgtatggcaggtgcggtttcagatcaaaaaattatggcaagtccaaaaattatggc

SEQ ID NO: 16136 - DNA, 573 bp, Zea mays
  Clone ID: LIB3279-229-Q6-K6-B2
cggacgcgtgggcgcgctgtccggccggatcctcgagctgtcgccgaccaaggactgacggaccgcagacggatcggatcgagcggcgtgacacgagactctcgcctcagggtgtcttcgcacgcacgcggcaatggtcctctgttcaccgtttgagcggcgggcggaacagccgtaaccgaacaggagacgaggagatctgcagcccaacaccatgaacgagcagaccggggctgctcgcgcggccggacacggcgtggaccggtgtccagactccggagatcgtcgcgccgacgacgtaacatgcggaacgctactagtacaagtagagatggccaaacgggccggcccggcccgggcccggtgaagcccggccaaaaccgggccgggccggcccgtttagcacaaaaaaacaggtcgaaaagcgggctaaacgggccggtaagcacgttttagtgtaaaaaaacgggcttagaggtaaacgggccgtgccgggctagcccgccgtgcctagtttcctgtccaagcccgcccgcttattctaccgtgccgggctcggaccgggcccaaaaa

SEQ ID NO: 16137 - DNA, 633 bp, Zea mays
  Clone ID: LIB3279-229-Q6-K6-B3
gcctgagaaggcccgctcgccattcttgtcaagatcatccacgaatgtcatccttcctcggcgggtgaacggagaggaaaacagcacaccgaacaacaagtgcacggcggtggaaatagcttccatatcagttgacaagaaccagatgccagatgtctcttacgcgatcacccactacaggttgcttgtggaacagcttgaaagagttgatctgagcgtgtcggagaacagcgttaagttggccttctggattaacgtttacaattcgcttatcatgcatgcgtatctggcatatgggattccaaacagctctctgaaaagaatggcgctatttcacaaggctgcctacaatattggaggacatgccattaccgccaatgccatcgagcacgccttgctgtgcttcaggtctccacggatcggtcgttggttcgagtccatcctctcgacggctatgcggaagaaatgcccggacgagaagcagctggttcagctcaagttcggcctgcaggagtgccagcctctggccctcttcgccctgtgcaccggcgcttcgtctgatcccatgctgcgggtgtacacggcgaagaacgtgatggaggagctggagcgcgccagcgagagttcctgcag

SEQ ID NO: 16138 - DNA, 436 bp, Zea mays
  Clone ID: LIB3279-229-Q6-K6-B4
atccgatcttgggacatggcgtcggtccaagtgtctgtgaataaggcttttcttgccctcctgtggcgaatgcaattctcctggcgcccattccttgccaatgcgacctgtgtgtgtcatgcctctggcgactgggagcctcaggaggagcctgtaggattcagtcagaggtagacaggtcagtgaagaaagaggaggggcgcgcagtcacattggcgagtgttttgtttttttggcggctaaatgctgagtatgttcagctgcatgtgtcctttttgtgtatgtgtacgtgtaagacgtgtaatagcaaccgtgtcaggtttggctacctgagaggcctttgaagcttctgctgctgcttccttccccttgggaattgggagttcagagttgaaatgtaggataggggatgttgttgagtacagcaactgttttt

SEQ ID NO: 16139 - DNA, 658 bp, Zea mays
  Clone ID: LIB3279-229-Q6-K6-B5
cccacgcgtccgcaagaatattgttctagctggagttggaagtttatccttgatggatgataatgtagtcacagaggaggatctgaatgcaaatttcctaattcctcctgatgagagcatatatggtggtagatctcgagcccaagtttgctgcgagtctttgatagatttcaatcctatggttcgagtttctgttgaaaagggtgatccatcattaattgatggagaattccttgacaagtttgacattgttgtacttagccgtgcatctcttaaaacaaagttgttgattaatgaaaactgtcgaaagagaagcaaacacattgcattttatactatagattgcaaggattcatgtggtgaaatatttgttgacttacagaagcatagctatgttcagaaaaagcctggaggagcaactgaacaacaggagttgacatattctagtcttcaggaagctatctctgtgccttggaatagtctaccgaagaagacggcaaaattatactttgctatgagagtactggaggattatgaattatctgaagggcgcagccctggcgaaacaacactttctgacatagatgcagttctggctcgaaggaggatatgtgtgataaatgttttgaatgagtctcgattcctactactctcggga

SEQ ID NO: 16140 - DNA, 587 bp, Zea mays
  Clone ID: LIB3279-229-Q6-K6-B6
tgcgaagtcaaggtaagaggttcggcactattgtgttctgattttatacactgtactcattggaagtccgttgtttcgtttttcttggtgttatccttgtattacgattttcttcatttttttaaatggtttctcgaatattttcatccttgttgccgaggatcccgtttgggacgatagttggtttccatattgccagctggtgccagtatggttaccgtgaaatctctgagtgagagcacaccgtccgcatcttccatcagctggcacatcgcaaaattgtatactgttttgctcttgggtgttgcattgcatgtatagttttagcttgagcggttgattggccattcgcatacggtgacaaggcaggtaggcattaggtatcgtttcccgtgctgttctaagttgtgtgagtaggctgcgttgcttctttgtttttgtctagccttgctttctttccatgcctgtgcatagttatttctttttcaggtcagcattcattgtacacgttccatctcgtgtacattgtacttattactcccccctgtccccgaaaatctcgtgtactttggattgaccttaacatg

SEQ ID NO: 16141 - DNA, 624 bp, Zea mays
  unsure (1)..(624): unsure at all n locations; Clone ID: LIB3279-229-Q6-K6-B7
ctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactntggggctgaatat

SEQ ID NO: 16142 - DNA, 631 bp, Zea mays
  Clone ID: LIB3279-229-Q6-K6-B8
cccacgcgtccgcccaactccgtccctctctcccagctcagatagatctttcccccgtcctccctcgccttcgccttcgccttcgccggcaggagatttccaccaccaccgccggaccgccccgaccctcctcccctctcgcgctatggcccagactgttgtgctcaaggttggcatgtcctgtgagggctgtgttggagctgtcaagcgggtcctgggcaagatggaaggcgttgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatcaggaagtgcccggcaaggcggcaaagaaaaaaatgtgaatgtatttagcttggatctgttacaaataattgcaaactgctagctcggtctgtacattttacagttgctattcgtgtactgtgatgttctcgtaagtttggggagatgataaaccaatatttgtatgatatatgtgttcgggttccataaggtaaggttttgaccgggtgctatcatc

SEQ ID NO: 16143 - DNA, 672 bp, Zea mays
  unsure (1)..(672): unsure at all n locations; Clone ID: LIB3279-229-Q6-K6-B9
cttctccgtcagccgcgccgccgcccgcctccccaactgtcaggcgccgcgatggaggctctccacgaggagatgcccttcgacctcgacttccacccgtcgtctccgctcgtcgtcacctccatcatcaccggagagctctgcctgttccgctacggcccggagtcgcagcctgagaggttacttttgttaaaagcccacaaggagtcatgcagagctgttcgttttgtggactcaggaaaagtgattttgtcagggtcagctgattgctcagttcttgcctcagatgtagaatcgggcaaggccattgcccgcttggaggatgcacatgagaatgccataaaccgccttgtctgtcttactgaatctacaattgccacaggtgatgatgaaggctgcattaaggtatgggatacccgggagcgatcttgctgcaacagttttgaagtccacgatgattacatttcagatatgacctatgtggctgagacaaatcagatactggccacaagtggggatggaactttgtctgtgaacaacctgcggaggaataaagtaaggtcacgatctgaattttcagaagatgagttgctatcccttggtgttaatgaagcatggtaaaaaggttgggtgtggaactncaagtggagcactcttattatattcatgggg

SEQ ID NO: 16144 - DNA, 541 bp, Zea mays
  Clone ID: LIB3279-229-Q6-K6-C1
ttggaaaattcagacttgagctagaaccagaggaacaccaaacacgcactgcgcccaccccccgaaacggagagaactgaccccgcagagaagatggccggcgagatgagctgggtgggcaagaagatccacctctacaacgtcaccatgggcctctacatgctcgattggtgggagcggtgcctattcaacatattggtgctgatcctgctctggttcgtttgcttcaatggctcccgcttcgcttccgacgtcttcgaaagccacctgaaggcgcggattttccaaggctcaaattacggcctggcaattggcacgccctcctcataggccttcagcgcaacacacagaagcagcgaaatctgctggttctggaatgttaactagttcccacaaactttagcgctgtcgtgatgtgtatgatgtggttccaatatgtaagatttttttacagttattctcttctctttattttcttggtttgtgtttgattacacgatatcacaccctgaattctactgtaattgaaaaccattttctt

SEQ ID NO: 16145 - DNA, 558 bp, Zea mays
  Clone ID: LIB3279-229-Q6-K6-C10
cgtgaatgttgctctaattgagatcggtgagaacgccttactgagcgccctcccatggagtaaaagaagctccagaacatggaggggcacctcatctcctgatctgggggtggaggtctggagtattctcaaggactggatacacggggcacggatgtttgtggtgagcaagagagataatgctgggatcatactggacagaattgtgaagcaggaggtcgaagcaagagggtgggtgaaactgatgatggcgcaggtggttgtcatcaccgaggagctcgaagggggagtaatggaggagctggttgaagaagcggtgctggatttttacagtctgttttcagtggtgagatatcgattgtgactggtaaaactttccacggagcagctggtttgtgtatgctctttgttttgcagctacaccggtcgttcgccgccgtatccattcccccctggttctctttctagctggttctgcttcttgtattacaaagtttgtataaacttctggtagatgagaacatggtaattgtgcagttcatgagaagttttgtaggc

SEQ ID NO: 16146 - DNA, 663 bp, Zea mays
  Clone ID: LIB3279-229-Q6-K6-C11
actagttctagatcgcgatctagaattacaaggccctttccatgctggaaagggacggtggattgatttcccagactgatgctgctggtgtgaagaggaggtgtgcgtgggtgacagcaaataccgatccctgttatgctgcatttcatgatgaagagtggggagttcctgttcatgacgacaagaagttatttgagctgctagtgctgtcaggagcattagctgaactgacatggccagcaattctgaataagagagacatattcagggaagttttcatggattttgacccagtattggtttcaaagttaagtgagaagaagattattgcgcctggaagtcctagctgctccttgttatctgaacagaaattgcgtggtgttattgaaaatgcacgtcaaatactcaaggtttgtttgaattaaatcacaagtgtatgtaccttgcccttcttaaagcaagcaccataacctttacctgaagcccttgttagataatacttgttcttgtctgaattaagtgcatgccgttgcagatcatagaggaatttggatcatttgataaatactgttggagcttcgtgaaccacaaacctatattgagccgattcaggtactcccgtcaagtgcctgtcaaacatcgaaagcagatgccataagcaaa

SEQ ID NO: 16147 - DNA, 588 bp, Zea mays
  unsure (1)..(588): unsure at all n locations; Clone ID: LIB3279-229-Q6-K6-C12
gctctccaccgctatctcgcacgtcgctccccaaatcatcccatcctacgcccgcggccgtggcaccgaatccagaagcgtctagaagggggaggtggtcgcccatgaccgtctgaccggccgtcgccatgggatgcgctggatccactccaaagactgacgataatggtaagaatttgaggaaaccaaagccttggaagcacacccaagcaataacgccggcacaactcagacagatgcgtgatgaattttgggacactgctcctcactatggtggacagaaagagatttgggacgcacttagagccgctgcagactctgacctagcgcttgcgcaaaccatagtggatagtgctggcatcatcgtatcgaattctgacatgacactttgctacgatgaaagaggtgccaaatatgagcttccaaagtacgttctaagcgagccaacaaacttgatcagggacggttgaattgataaaataaacgtggggtccaatgtaaattatgtggatcacattattatactgacatcacgttggcatgattttggaacttcaataatattatgatgtgctagattctgattnt

SEQ ID NO: 16148 - DNA, 452 bp, Zea mays
  Clone ID: LIB3279-229-Q6-K6-C2
cccgcagccgccctagcacccgcgacgagcaggatctgcccagttgctcttgcggtagttcccccaactgtcaccatgcagaacgaggagggtaagactgtggacctctatgtccccaggaagtgctcggccacaaacaggatcatcactgccaaggaccatgcctctgtccagatcaacattggccacttggatgcgaatggcctgtatgatggtcacttcacaacgtttgctctctctgggtttgtccgtgctcagggtgacgcagacagctccttggacaggctgtggcaaaagaagaaggctgatatcaagcagtagattttacatctagtttaccaagaattggacaccgccttagctatgttttgaattcatgtcactatatgcaatgttgtgatttcagctggtaccttaaatctgaagatttagtatctttgttgggtttcttc

SEQ ID NO: 16149 - DNA, 612 bp, Zea mays
  unsure (1)..(612): unsure at all n locations; Clone ID: LIB3279-229-Q6-K6-C3
cggacgcgtgggctggaagtggaaagaagtgggttcttgcttgagctgagctctgcctcttgctgcccttggatctgtttgggagtggagaacgcagtatggggcgcggcaagatcaagatcaagaggatcgagaactctaccaaccggcaggtgaccttctccaagcgccgggccggactggtcaagaaggcacgggagatcggcgtgctctgcgaaaccgaggtcggcgtcgtcatcttctccagcggcggcaagctctacgactactgctcgcccaggacctcgctgtccaggatcttggagaagtaccagaccaactcggggaagatactgtggggtgagaagcacaagaacctgagtgcagagatcgacagagtcaagaaggagaacgacaacatgcagattcagctcaggcatctgaaaggtgaggacctgaactccctacagcacagggagctgatcgctattgaagagggcctccagaatgggcagaccaacatgcgcgagaagcagatggactactggaggatgcacaagacgaatggaaagatgctggaggacgaacacaagatactgactnttaggatgcaccaacaggctgttgatctga

SEQ ID NO: 16150 - DNA, 529 bp, Zea mays
  Clone ID: LIB3279-229-Q6-K6-C5
cgacgttccacgggctccggcggcggcaggaacgcctcccgatttcgacggcagagcgagagagcgatggcgctgactaacttcatcgtgacggtggccgtggttggcgcgggggtgcttctcttcaccaccgacatccgcaggtctggcgccctcttccgccgcaacgcgcgccagctccggcagtggctcgaggaggacacggcctccgccgcgtccaagtctgcaaaagaagcagctcaaaagaaactcgactcgacggtccccaaggagaagcaaaaggaagatagccactgattggagctgtttatatgaacggtataacccctatttgaagtcgttcaagttctgttttctacagttgctgcgatacaaacttgtagctctcaagtaaggtgcacggcaagattatgtttccgtttcaacatcggcctctgtggaacagctagctaaatgttggtattacgtcgtgtgcttatatggatccgaagcactttgctaatctacacgtagctcaaatccttgttga

SEQ ID NO: 16151 - DNA, 647 bp, Zea mays
  Clone ID: LIB3279-229-Q6-K6-C6
cccacgcgtccgcgtccgccgccgccgaaggacggaaggagaagagggtacggccgtctccttgcccccatggcccacgagaagaagctgtccaacccgatgcgggagatcaaggtgcagaagctcgtcctcaatatctccgtcggggagagcggcgaccgtctcacccgcgccgcaaaggtgctcgagcagctcagcggccagacccccgtcttctccaaggcgaggtacacggtgcggtcgttcggcatccggcgtaacgagaagatcgcctgctacgtcacggtgaggggcgagaaggccatgcagctgcttgagagcggcctcaaggtcaaggagtacgagctgctcaggaggaacttcagcgacaccgggtgctttggtttcggtatccaggagcacatcgaccttggtatcaagtacgatccgtcaacaggcatctacggaatggacttctacgtcgtgctggagcgtgccggctaccgtgtggcgcgccgcaggaggtgcaagtcccgcgtcgggattcagcacagggtgaccaaggaggactccatgaagtggttccaggtcaagtacgaaggcgtcatcctcaacaaggctcaggccaacacgttgtaaacctcacccgtgggcaaaacagctctctg

SEQ ID NO: 16152 - DNA, 543 bp, Zea mays
  unsure (1)..(543): unsure at all n locations; Clone ID: LIB3279-229-Q6-K6-C7
tgcatctgcgcaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatgccctggcctggcctgccccaccaccgccaccgacggcgccgccggccgcatcctcattccaatcataatagacgacccgcagcattaattatccaccggcttttttttttggctctttcttgcccctgttatctttctcctcctcttcttcttgggaattgtcgctgccgtttcgatacgtaaatcacgagatcggtaatacagtaatgctcctcaattntccantnna

SEQ ID NO: 16153 - DNA, 587 bp, Zea mays
  Clone ID: LIB3279-229-Q6-K6-C8
ctttttccagtactaattcaacctgaaattatactctattcaattttttttgttcttaggaaatctactgatgatggtatatcatcctgggactggaaattaaagggtgatcgttcaacgtatcatgctttgtttcctcgagcatggactgtttatgatggcgagccagatcctgaactgaaagtatcctgccgtcaaatatctccatttattccccatgattaccaggagagcagccttcctacctctgtttttgtatacactctagtgaatactggaaaggaaagagcaaaagttagcctattgatgacttgggcgaattctataggaggactttcacatcattctggggatcatgtaaatgagccattcgtagggaaaaatggagtttctggtgttcttctacatcacaagacagccaataataatcctcctgtaacatttgcaattgcggcatgtgaaaatcaaaatgtaaatgtcacagtattgcctgtttttgggctttctggagaaagttctgttactgctaggggaatgtggggcacaatggttcaggatgggtcctttgatcgagatatctcatactg

SEQ ID NO: 16154 - DNA, 650 bp, Zea mays
  Clone ID: LIB3279-229-Q6-K6-C9
tctacctcgtgctccgtgccctcgacaccgttgaggatgacactagcatcccgaccgaggtgaaggtgcccatcctccaggaattttatcggcacgtctacaaccgcgactggcattattcatgtggaacaaatcactacaaagtgctgatggataagtttcacctcgtatccactgccttcctggagcttggtcaaggctatcaaaaggcaatcgaagaaatcactaggcgaatgggagcaggaatggcaaaatttatatgcaaggaggttgaaactgttgatgactatgacgagtattgtcactatgtagccgggctagttggttatggactttccaggctcttttatgctgctgggacagaagatctggctccagattcactatcaaattcaatgggtctctttttacagaaaactaatataattagggattatttggaggacataaatgagataccaaagtcccgcatgttctggcctcgagagatatggagtaaatatgcagataaactcgaggatttcaaatatgaggaaaataccgaaaaggcagtacaatgcttgaacgatatagtgacgaatgcactgattcatgccgaagagtgccttcagtacatgtcagccttgaagaccatgccatcttccgttttt

SEQ ID NO: 16155 - DNA, 621 bp, Zea mays
  unsure (1)..(621): unsure at all n locations; Clone ID: LIB3279-229-Q6-K6-D10
cggacgcgtgggtccaactcctgagcacgttctgctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccgggcgccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtangctgc

SEQ ID NO: 16156 - DNA, 634 bp, Zea mays
  unsure (1)..(634): unsure at all n locations; Clone ID: LIB3279-229-Q6-K6-D11
gtacgtctccgtcgagatggccgccccgctccggcggagcctcccctcccttggccgcgcgcttctcacgccgccgacgccggcgccggcgcggatgctctccgcggaggcctctgatgccctcgttgagatcaagcccggggagatcgggatggtctccggcatccctgaggagcatcggcgccgtaaggttctaatttattcaccagctaggactgcatcccagcaaggttcaggcaaagtcgggaggtggaaaattaattttttgtcaacccaaaagtgggagaacccgttgatgggatggacatctactggggatccatatgctaatgtcggtgaagcaggacttacgtttgacagtgcagagtcagcaaaggcgtttgccgaaaaacatggatggaattatgtggttcggaaacgccatgcacctcttctgaggcctaaggcctacgctgagaacttcaagtggagaggtcctccgaaagcggagcaagcatgagctcgagacatctgtgatgctgacattggcacgatgtcgttttcctcctggctcgattntattttgctttcaaccgtgcccattggtaaagtacgaactagagtatgcatctatcanacttgtaataagcatgat

SEQ ID NO: 16157 - DNA, 662 bp, Zea mays
  unsure (1)..(662): unsure at all n locations; Clone ID: LIB3279-229-Q6-K6-D12
cgctccatcacggacgagatctccggcgacttggagagggccgtgatcctgtggacgctggacccagcggagcgcgacgcggtgctggccaacgaggcggcgcggaagtggaagcccgggaaccgtgtgctcgtcgagatcgcctgcacgcgcacctccgcgcagatcttcgcgaccaggcgggcttatcacgagcggttcaagcgctcgcttgaggaagacatcgctgcgcacgtcactggggacttccgcaagctattggtgccacttgtaagtacttaccgctatgatggaccagaggtcaacacaaggttggcacactcagaagccaaactacttcatgagaagatccatcacaaggcttacagtgatgatgagatcatcagaatcctcaccactaggagcaaacctcagctgattgctacattcaatcattacaatgatgcatttggccaccgaatcaacaaggatctgaaggctgacccccaggacgagtacctcagaacgctgcgggcgatcatccggtgcttcagttgccctgacaggtactttgagaaggtggctaggcaggccatagcggngctaggcacagatgagaactccctgaccagggtcatcaccacccgcgctgaggtggacctcanactgattaaggaggcgta

SEQ ID NO: 16158 - DNA, 565 bp, Zea mays
  Clone ID: LIB3279-229-Q6-K6-D2
acagggtgaaataccaagcgaacaacatcttgtgttggagctgctagaagatggaaaggtggttacttcagatgatcctcatgttgtgtttggtagcttggacagcgcattcatacagacgtcaaatctgcgaccagggaaccttctccgctttgctgttagagatgaaagtgtgaaactcatggatggaaagatgcatataggtcagctgcaatttgttggaaagccaaaccgagctcgtgcttttgctgacagccattcgaaagttttgttccagtatgcggcaaggcatgttcctctgagaattgaggatctggttgcctccattcaatcaaacaatatggaggttgaatccaccgatgttgaaatgcaagattaaggttgaagaggtaggctttcatgtcagcattttaacaaacgacatggtcgtctgaaaccatggttttcagggagtgcctcacggcctataaaaggtttaaacagcgcacgagttttttgtaagatgaacattctgaacattgccatccacgtgaatgtgactggtataggagtagcgcaactcaat

SEQ ID NO: 16159 - DNA, 453 bp, Zea mays
  Clone ID: LIB3279-229-Q6-K6-D3
gcggatcgaaggaaggaaggaaggaggagatgggtggcggcatggaggtgcacaaaaaccggtggatcgaagagtggaacgccggccgcgagaacctcgagttcaatttccgctggacccgccgcagcctcgccgtcgtcggcctcttcggcctcgctgtccccatcctcgtctacaagggcatcgtccgcgaattccatatgcaggacgaggatgcaggccggccatacaggaagttcctgtaagcggcgtccagggccgcaggagacgtcgatccctcgaccggggctgcgaggaggggagtttccattcagtttgtgtcggtattgttttagtctgaatctgatggagcagtttggaatgctgaactattgtgcctgatccaaatgaataaggtgtaatgactcgtcttttcaattactgaaactgaacatgtttgaatttattctggtc

SEQ ID NO: 16160 - DNA, 475 bp, Zea mays
  Clone ID: LIB3279-229-Q6-K6-D4
cccacgcgtccgcaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgt

SEQ ID NO: 16161 - DNA, 649 bp, Zea mays
  Clone ID: LIB3279-229-Q6-K6-D5
gctttgcgtgagatctcagggcgtttggctgaaatgcctgctgatagtggttacccagcttacttggctgcgcgtttggcatccttttatgaacgtgctggtaaggtgaaatgcctgggaagtccagacaggactggcagtgtcacaattgttggagccgtctctcctccaggtggtgatttttcagaccctgttacctctgcaaccctcagtattgttcaggtcttctggggtttagataaaaagctcgctcaaaggaagcatttcccatctgtgaattggctcatttcctattcgaaatactccaaggcccttgagtccttttatgagaagtttgatccagatttcattgatattaggacaaaagcacgtgaggtgttgcagagggaggacgatctaaatgaaattgtgcagcttgttggtaaagatgcgctggcagaatctgacaagattacactggagacagcaaagctactgagagaagattatttggcacaaaatgcatttaccccatatgataagttctgcccattctacaaatccgtttggatgatgcgcaatattattcacttcaacacattggcaaatcaggctgtggagcgggcagctggtactgatggccaaaagataacatacggtgtcataaaac

SEQ ID NO: 16162 - DNA, 662 bp, Zea mays
  Clone ID: LIB3279-229-Q6-K6-D6
cccacgcgtccggaactatccagaagcgcaagactccaaagccgtcgccttcctatccatcccttcctcgccacgggggtcgcctgagatcacataaacaatggtgaaggctgttgctgtgcttggtagcagcgatggtgtcaagggcaccatctttttcacccaagtgggagatggccctaccactgtcaccggaagtgtctctggcctcaagcctggcctccatgggtttcatgtgcatgcgcttggtgacaccaccaatggctgcatgtcaactggaccacactacaatcctgcgagcaaggaacatggagcaccagaagatgagaaccgccatgccggtgatcttggaaatgtgacagctggagcagatggtgttgcaaacattaatgttaccgacagccagatcccactgactgggccaaactcaatcattggcagagctgttgttgttcacgctgaccccgatgatcttggaaagggtggacacgagctcagcaagagcaccggaaacgctggcggccgtgttgcttgtgggatcatcggactccagggctgaactgaaacgaatggtcgctggacttcgggggcgcctgggagtgccgtcaccactcaccagcaggctagaataacatcccgagacatcgtgaaataataataat

SEQ ID NO: 16163 - DNA, 665 bp, Zea mays
  Clone ID: LIB3279-229-Q6-K6-D7
gaggtatcctgccctgcagttcctcctcggcggaaaccaagaccctagctctcgtcatcgtcgtcgtcggcggcggcggcgaccgcggcggatccgacagccagccctcgtcgcaggataaggatatccatcgcatcgcatggcagccgggccgccatgccgtcgtccagctcccaagacggcgtacctccttatgttctccagatccggaaccgtgcggatggtgttcggggttcggcgaccggaaagaaaaacgttttggcccgggtatacagcgtcttctgttactctttcctcccatattatggttcgtttatttgaccctgcagctggactgtgaggagcctatatattctatattcattgtatgcatccatattccatgcaatcatgtcactttacatttcccccatcatgcagtcttgacataaggttggagagttggaatgactactcaagacgtcggttagcaatggactgttcggttagcactggattaaaaaggattgaaggaaattaaattactaacaaattaaatttcttgttagtaaaaaataattagaagaggatttaatcacttaaccttaatcctcttcgatctaagaatttactgtccatgatcttcacgcgatgcttgtgttgatgccctcagtctcagctacgta

SEQ ID NO: 16164 - DNA, 649 bp, Zea mays
  Clone ID: LIB3279-229-Q6-K6-D8
tgatttcatcaacccaactgctccagctaacatatccacatcatcccattcaaaggcagaagcacatccaccgccaagttatggtggcaggccagacagagtatctgacgacttcataaacccaactgcacctagcttctcggcgccttctcgtcctacaaatgaggagccagcacgtccatccgtgaagcagcaagagagcctacctgacgacgacttcataaacccaactgctcttcctggtttctcgtcgtcttcagctactaaggagtctggcgaggaccttccgaaggctccatgggaagcacaagctgccgcaggttccctaccgccgcctccggcgaggtatggccagagacagcagtacttcgagcagaacgtgtattctggcgggagcaacgaaggcgggtacaatggactgacgacacagaccgaaggcctctcgctgaacccgcggagcagcgagaacgagaggagcacggcacggccggcagcgtcccgccctgccaaacctgaggactcgctcttcaaggacctggtcgacttggcaaagaccaagccttcgtccccgtcgaaaccggccaacagccgcaggacccgctagaacgactcgtgcgatgcatggatggacattgggtcgttcggatat

SEQ ID NO: 16165 - DNA, 667 bp, Zea mays
  Clone ID: LIB3279-229-Q6-K6-D9
cccacgcgtccggcatattcaaagcagcttttcatcgccctgaagcacctgaagaactgcaaagttttgcactgtgatattaaacctgacaatatgctggtgaatgaggctaagaatgtgctcaagctatgtgattttgggaatgctatgcttgctggtatgaatgaagttacgccttatcttgttagccgtttctatcgggcacctgagatcattcttgggttagcctatgatcatcctttagacatgtggtcagttggctgctgtctatatgagctttataccggtaaagtcttatttcctggtccatcaaacaatgccatgcttcggcttcatatggaattgaagggtccattccctaagaagatgcttcgaaagggtgcctttactatgcaacactttgatcaagatctcaattttcatgctaccgaggaggatcctgtgacaaaaacggctgtgagaaggttaattttgaacattaaaccaaaggatgtcggttttttgattttgaactctcctggcgaggatccaaaaatgctatccagttttaaagatcttcttgataaaatgtttatattagatccagaaaagaggataaccgtatcacaagcacttagccatccatttatcactggcaagtgacataagatgctgattcctcttgata

SEQ ID NO: 16166 - DNA, 555 bp, Zea mays
  Clone ID: LIB3279-229-Q6-K6-E10
cccatgcgtccacccattacctcatctgggagctgggccttgctgttccccctgccgatacggggaccgagaaggagaacccaaggcgccgcgcatggcgtcgtccatggactactcggctgagaacgcggatgaggcgccggaggaggagccccaggcccagacacagcctaacacagaggtgaccgaggaggctcccgatgaggctgaagatgaaccgcaaaccctagagctagcgcacgagctcttcaacaggagttacaaggacatctaggatgacgacttagactacgtcatacactgtctcaagagaacgctttaaaacagggcttagcattatggagagctcgcgccggaatagtccaaatcatacttcaaatatggatgcacactgctatacaaaactcatgaggagagtgatgttttgagaaatgttcccaatagctagtcaaatgaaaactcagtgactagtacagatactaaagattacagtggaacttcaaacgactctggtactgatgcggaagatgctgacgtatcagataaagaaggtgc

SEQ ID NO: 16167 - DNA, 557 bp, Zea mays
  Clone ID: LIB3279-229-Q6-K6-E11
ccctctcaaaactataaaaaaaacccgagaaaacaccgagatccgcgcgttcctcggcgtccgcacggcccgcgcacgcactcacgcacccatccggttgccaacccatcccccgaccgacgccaccccacatacatgccgccgcccagcctcaccgccgccggcaccaccaccaccacaacggggcgccgcaacgaccgagccgcgaaggtccaccaggtactgggcgaaggcgcggggacggaggagatgggcgcggtggcggacgggtggacgcggcccgagtggtgctcggcggcgggcgtcgcgggcgtgctgcggcggcacccggcgcccgcgctcttcgggtgcggcctcctgctcttcatggccgtcgagtacaccatccccatggtcaagccggacgcgccgccgctcgacctaggcttcctcgccaccgcgggcatgcacgccgccatcgccgcgaggccctggcttaactcgctcctcgccgcgctcaacacggtcttcgtcgcgatgcaggcggcgtacatcctgtgggccatcctcgccgagca

SEQ ID NO: 16168 - DNA, 625 bp, Zea mays
  unsure (1)..(625): unsure at all n locations; Clone ID: LIB3279-229-Q6-K6-E12
ctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttcccgggtgcgggtggtcgaatccttccatccaccaggagagctcgtggcttgtctttgattagctcggtctcccctgtgtccgtgatctgatatacgtccggatctgtctgctgtaatcatcaggaaggtaggaggcctgaggggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgnctggttccgcgaccactggtcccgcgagcacgcccacctggatgagatagccgagcagctc

SEQ ID NO: 16169 - DNA, 567 bp, Zea mays
  unsure (1)..(567): unsure at all n locations; Clone ID: LIB3279-229-Q6-K6-E2
cccacttaaagtttctctggaagatctttacaatggcacctcaaagaagctctctctttcgcgcaatgtcatctgctccaagtgcaagggcaagggctcgaagtctggtgcctcaatgaggtgccctggttgccagggctcaggcatgaaagtcactattcgtcagctgggcccttccatgatacagcagatgcagcagccttgcaatgagtgcaaggggactggagagagcatcaatgagaaggaccgctgcccagggtgcaagggtgagaaggtcattcaagagaagaaggttcttgaggttcatgttgagaaggggatgcaacacaaccagaagatcaccttccctggtgaagctgatgaagcgcctgatactgtcactggagacattgtattcgtcctccagcagaaggatcactccaaattcaaaagaaagggtgaagatctcttctatgagcacaccttgtctctgaccgaagcactntgtgggttccaatttgttcttacacatctggacaacaggcaacttctcatcaaatcagaccctggtgaagttggtaaacctga

SEQ ID NO: 16170 - DNA, 389 bp, Zea mays
  Clone ID: LIB3279-229-Q6-K6-E3
tcctgctgtggaaggaaaagcctcgaagagaaatgcattctgcaaagtgcgtcgatctgcttcagtatctcgtagtctacaagtcttggagagagcacgtttctgcgggggaggaaaactgtttgaattttgtagtgcctgttttttgttagcctccagcgaagacttgattccggcatattgcttgttcacgcaccgttaacaccgattaagattggcccagccgtgcaggaattgccgggtgtgttttcaccccctcgctaatcgatgtccagaatctgtgtgcccacgggtgttgtattgaccctagctttgtaaccatgcacatgatttcttttttaacgctgatggatggcacctggatctctgtccatggccatcgtaatccc

SEQ ID NO: 16171 - DNA, 591 bp, Zea mays
  Clone ID: LIB3279-229-Q6-K6-E4
cgatatttcaatttgctgatccaatgcattaacattggtaacaagaatgttgtgcactgttacgattttactaacataacatgatttgggatcaaagactgaactgatgtgctttgtgaatgatgactttggttaaatgtgctaataaagcactctggatgtcatgtcaactcttaccattccattcaagctttcatggagattgtgctcaattcagtccacaaaggaacaccaggggatttatctgttgccacactgaataatttaactttgctgcaaattatattgtacttatggtggtatatgggaaatgcacatttctgttacctttattttgttcaggtatatgacatttaatattcattcttaggttgtatctgtcattgaaagacgtgcagaacaattggattatgtactggtggacactcctggtcagattgagatcttcacttggtcagcttcaggagctatcattacggaagcttttgattcgacgtttccaacagttgtagcatatgttgttgacactccgagatcaacaaaccctgttacttttatgagcaacatgctttatgcctggagtattctcta

SEQ ID NO: 16172 - DNA, 485 bp, Zea mays
  Clone ID: LIB3279-229-Q6-K6-E5
aacatttgagttttagttcatcatcttatattcaaataggtttagctccatcagatctagcttcaaaaaattaaaataaactcaaaggatatttcaaaaacgttgttttcatatgctcataaagttacacgaaattatctgccataccattattcctttcctattaagccgatgtagctcccttcccgttcaaggcatccacgccgactgcaatatcgtggccacacgttttcatcttcgttgcacgcgtggcaagtccggcatcctaccttcctagggaaaaaaaagctgaaaaatccaactccgcagtactgtcttacttatcttcgctacatctggatgctgcttcttatcttcgctacacaagcatgtctccaactccgcagtgctgtcttggaaaaaaggggtctgtactttctctcaccccgacggcgcttcctacttcctagggcgaccgcggcggcgccacatgcttcgccagcgtc

SEQ ID NO: 16173 - DNA, 650 bp, Zea mays
  Clone ID: LIB3279-229-Q6-K6-E6
aagagattgaaggggaatgtagtggatatctttgcataaagaaatcatggcctggggctttccggactctgtatggagatcatgagagatacgagaccacgtacttcaaaccatttgctgggtactatttcactggtgatggttgcagcagagacaaagatggttaccactggctgactggaagagtagatgatgtcatcaatgtcagtggacaccgaatcggcacagcagaggttgagtcagctttagtgtcacatccacagtgtgcagaggctgctgttgttggtgttgagcatgaggtcaaaggtcaaggaatttatgcttttgtaactttggtggatggtgttccgtatagtgaggaactacgaaaaagcctcataatgacagtgcgcaaccagattggggcatttgcagctcctgacaagatccactgggcaccgggacttcctaaaacccggagtggcaagatcatgcgaaggattttgcgcaagattgctgcacggcaactggatgaacttggggacataagcaccctcgctgaacctgctgtagttgaccagcttatttcgctcagcaattgttaggttgcaacgtaattggatggtggatacatccttgagcgcatgttgcgtttgtctggaatatgagta

SEQ ID NO: 16174 - DNA, 634 bp, Zea mays
  Clone ID: LIB3279-229-Q6-K6-E7
gtcattgagtccttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttgagttcgagaagtttgcagctggcactgaggcgattgccaagaagctagctgagcttacaaccacgaagggtgtcactaccatcatcggcggcggcgactctgttgctgctgtcgagaaggctgggctggccgacaagatgagccacatttcgaccggcggcggtgcgagcttggaactcttggaaggcaagactctacctggtgtccttgccctcgatgacgcctagatccgctgctgctgctgctactcaggttctgccagctttgcgtgtcatc

SEQ ID NO: 16175 - DNA, 654 bp, Zea mays
  unsure (1)..(654): unsure at all n locations; Clone ID: LIB3279-229-Q6-K6-E9
cgtcatcgtttcgcgtccgcctcagcccgccgcaaggagaggtaagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacanaatcggcatcatctaagtgctgcattaggcatcctagttcatctgttgtgtcctagttctatgtgaaaccagagttttgtagctatggctctcaatcgttccattaccatgtgttatgcacacttctgaatttgatat

SEQ ID NO: 16176 - DNA, 462 bp, Zea mays
  Clone ID: LIB3279-229-Q6-K6-F1
tgtcctggccgcaacgttcgtgactcaagaagagcttgcgctaacgctcttaggggcagggctggcgctagggcgctatatggataggtgcagataaagatcctaatgttcggagagaggacgcgctgcagctgagcttggatggagagcaaggatgcccgaacaagcatcgaggaatgttctgcgctcacagctccagctacgaactgggcaagatgttgcctttctagcgaagaaagaagtaagtgatgtaagagaatgtatccagcgttcgggctatgaggagcatagctgtgaaacactcgagctgctctctaggtgacagactggacactcaaaacatggtcatagggtgtgtctagtctgcccttccgtgctaccggacacaagttcttacatatatgcttgggacgatagagatagcatatagagtatgactgggtcaattgataatgcggcgtt

SEQ ID NO: 16177 - DNA, 635 bp, Zea mays
  Clone ID: LIB3279-229-Q6-K6-F10
cacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccggcgcgtcgcccaagccccgcgggcgc

SEQ ID NO: 16178 - DNA, 627 bp, Zea mays
  Clone ID: LIB3279-229-Q6-K6-F11
cggacgcgtgggcggctgctcccaagattgctaaacaagagtccagtgatgatgacactagcgacgagacctttgaatctgatgaggaacctacaaagaagcctgctgctaaacccttggctgcagttgcaaaaaatggttcgaagacggtcaagcaagagagcagcagcgatgaggacaggtctgaagatgagtcggatgacgacagtgatgatgtgagttgaagtttcctcggcgtccctgcatcgcttccaccagccctccccacacgcggcgacagggtcgtcgtcgtcccggctccgcgtcggccacacccgaacgaccgtctccatgtcgtgccgtctccagttatgcgagcgaggctggataaggtcgtggggttccaacaaggtggtgcagctccattcgtccctccacctcacccgccggccatctctcgatttctttttgtgtgctcagttttttctttgtgtgtcatgagtttcagaacttgattgggatggtttttgtgccatgagaattagggtttgatagggatgatttgggtatcagttcttacggtcactggaatttgcatattgtcatagtctaatgccattaaattttgagggtagcgatattgttttc

SEQ ID NO: 16179 - DNA, 667 bp, Zea mays
  Clone ID: LIB3279-229-Q6-K6-F12
gtgacttctgtctgcgtctcgctctccggggagtggtgggccgccgccaccctaagccagttgcggaggtttacattggtctcttcgccggcgacgagcacccaccaggagtcttgacaagtttttccaatggaccaagtaccgaatggaaggcataaggtttcttttgcgaagccaagagggggtgtgctttcagattctgactctgactctgaaggttttgtagaagagctaactcctgttcactcaaagtcaaacgggaaggcttcatctgcgagcctaaaaactggtggaaaggcttcagccctttctaaaggtgaggcaagcaaaggaaaagcatacagtagtgacaaaggtggaaagggttcttcatcacatgcagtgcctaccaagtctgatgcagaactaaagctagagcttgatatccctccaaattctagaatgctaatgaattgtgaagcagctgaactattgcaagaaattcacgagcacatggccatactatcagaggaccccaagatcaaaattcctgagtcatttgacaaagcttttcagtattcaaaagatggaaatcatttcaccactgcaagctctgtgaaacaagccattgaacctcttaaaaaatgtggggtcagtgatggagagatatgcatgatagcaaacattg

SEQ ID NO: 16180 - DNA, 649 bp, Zea mays
  unsure (1)..(649): unsure at all n locations; Clone ID: LIB3279-229-Q6-K6-F2
cgccgtccgcccacgcgtccgctggttgttgctccgtgtgcggtgcgaccagctcctagatctgaatcgaatagtctcgttgatttgttgcataattataaattgattgaataatatacttactaacttgaaaggattcgtctccggcattatctgcacttttgctttattggtgacaaaaacaatttctctggatcatttgctagaatagtaaatctatctagttgtcctataattaagctgtcatcagtaattttgtacatcaaacgttctagaaacatgagctaaatgcatctttactatttttgcctgtatcattctgtctcggcttcgccttttatcccgcgaaaccccaagcgccagaagcaaatttcatctgacctaccttttcgtttttatgcgatgcttcaacaggtcctggagcttgctgggaacgcagcgagggataacaagaagacccgcatcgtgccgcgtcacatccagctcgccgtgcgcaacgacgaggagctgaccaagctgcttggtggtgccaccatcgcgagcggcggcggtatgcccaacatccaccagcacctnctccccaagaaggctggctcgtccaaggcttccaccgtcgatgacgatgacaactgaagctggccactggaga

SEQ ID NO: 16181 - DNA, 357 bp, Zea mays
  unsure (1)..(357): unsure at all n locations; Clone ID: LIB3279-229-Q6-K6-F3
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggcgtaaaaaaaaaaaaaaaattttatttaaggaaaaaaaaaaaaagggggggttttttttttttaaaagggaattaaaattaaatggggggggtttaaaaattaaatggggggaaaaaaaaaaggtttttgaaaagtaaatttttatagagaaaaggaattttaaaatggggggggaaaaaaaaaaaagggggggaaggaaaaattgttttaaaagtgggggggnnaaataggaaaggg

SEQ ID NO: 16182 - DNA, 580 bp, Zea mays
  Clone ID: LIB3279-229-Q6-K6-F4
gttgaaaagagctatgagctacctgatggccaagtaatcaccatcggtgcagagagattcaggtgccccgaggtcctcttccagccatccatgattggtatggaggctgctggaatccatgagacaacatacaattcaatcatgaagtgtgatgtggatatcaggaaggacctctacggcaacattgtgctcagtggaggttcgactatgttccccggtatcgctgatcgtatgagcaaggagatcacttcccttgcaccaagcagcatgaagatcaaggtcgtcgcaccacctgagaggaagtacagtgtctggataggagggtcgatcctagcctcgctcagcactttccaacagatgtggatatccaaggaggagtatgatgagtctggcccggcaatcgtccacaggaagtgcttctaggttccgcaagttcctcattgttatctagtctcaagttatgcccccgtcatttctcgagatatgtgtggcagatttgcctgcgacgtttattttcatcggacctgagtcttctcggggttagcagctacctttgtatgttgtggctccctgtgcgagc

SEQ ID NO: 16183 - DNA, 513 bp, Zea mays
  unsure (1)..(513): unsure at all n locations; Clone ID: LIB3279-229-Q6-K6-F5
ccgggncgacccagcgnccgcccacgcgtccgcccacgcgnccgccgggcgcgcggcggccggcggcgagcccncacccaaccgagcaagccgaggaggaagcgagcgcgcgaaagnaccaggaggaggcacgggnacccaggggcgcgcgancnccacggngggcaagagganccggggcacggggcaggccagggagcgcgcgcgganccaccagccagggcggccaccgcgacgaggaacaggnnncaaggcancgnacaancangaagagnggngagaaagagccaagganccagagagangngnnngnngcncccagngcagcagncannggggaagnngagaaaggncanggancgncaagcggggacgganccananngagaggngangncaacagcaancaaannggancnggnaccaananacaagacaanncccnnngacaggnnncaaaagccaacacnnagcgggaaggnccncccaaccaaaannggaagcaacgggaca

SEQ ID NO: 16184 - DNA, 563 bp, Zea mays
  Clone ID: LIB3279-229-Q6-K6-F6
gccaggcgtccggccagcccgtaggccatccggttcgtcgatcggagcctcgttagcatcgactccacctactccttctagtacgctataaactagactagagcaatacgcgcagcggatgttccaccgcctgatgcggcgcgcgatgccgctcccgccgccgcatgctccgcttactgctgcggggatgccgggggtcaccggcggtcgcctgttcgcttcgctgccgttgcagtcgccaatacaggctcaaatagaggagcatgtgtcggatcagttgactgatgagttgaaagatgccatgcacatcaagatgcacacggagcttctttggaatactgaaaggaagactgacgtggatatgaacgggaaaaaggcgcagataggcgccgcgctgttccgtacactgctgtgcacaaatacatagagatatacagatcgcagagcagatccaagatcattagacttgaagaaaaacaaggatgtgctacctgaagtactgtacagatctgatgacagcacgatagaatggactatacatcacactatatcacacacatgat

SEQ ID NO: 16185 - DNA, 97 bp, Zea mays
  Clone ID: LIB3279-229-Q6-K6-F7
aaaaaaaaaaaaaaaaaaaaaaaaaaaaggggaaaggaaaaaaaaaaaaaaaaaaaaaaaaaaaaaaaaaaaaaaaaaaaggggcgggctgttttaa

SEQ ID NO: 16186 - DNA, 617 bp, Zea mays
  Clone ID: LIB3279-229-Q6-K6-F8
cggacgcgtgggcaccgaatgaaatcaattttgtcccattaaagcaggagaaaagcttcagagccgataaactgatggaattctataaatcagacatgaaactgaagaaattcttgcatataattgagaattctccagtgtacccagttatctatgatagcaacaggactgtattatcattacctcctatcattaatggcgcacattcagctatcacccttgcaacaaggaatgtctttattgaatgtacagctactgaccttaccaaagcaaatatagttctgaatacaatggttaccatgttctctgaatattgtgagactaaatttgaagtggaacctgttgaagtgatacatcatgatggaaggaaaacagtttaccctgatctttcatgttacaaaatggatgttttgttatctgacattcttgggcctattggcatctcccaggacgagaaacaggttgtctgtcttttgaataaaatgcaactgcaagctgaaagtcactccttgaaaggggaggctcgcatttcagtgtctgttcctccaacaagaagtgatattctgcatgcccgtgatttgtcagaggacgttgctattgcttatggattcaacaat

SEQ ID NO: 16187 - DNA, 618 bp, Zea mays
  Clone ID: LIB3279-229-Q6-K6-F9
cccacgcgtccgcccacgcgtccgctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacgccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattttggataatacaagctcattcgcagtagtttctgttgt

SEQ ID NO: 16188 - DNA, 474 bp, Zea mays
  unsure (1)..(474): unsure at all n locations; Clone ID: LIB3279-229-Q6-K6-G1
ccccgcgtccggtagaacagtgttaaaattttgggactagaaaatacaccaaatcagcaagggtgggacatgaggcattcttctacgcggaaacagtaggatagttccgtagtagttgtggcccaggtatgatgctacctagaaatggtggaatgaccattgctgctaggaggcggctgtaaatatgaacaattatagaggatgatttattcagattctttttttagggggtgtttgaatgcactatagctaatagttagttggctaaaaatttgctagtgaaattagctagctaactattaactaatttgctaaaaatagatatcttcaactaattttagcaattaactattagttttaatgcattcaaattcaaatacccctaaagaatatgcatggtggttgnaaaaaaaaaaaaaaaaaaaaaaaaaaaaaaaaaaaaaaaaaaaaaaaaaaaaaaaaaaaaaaaaaata

SEQ ID NO: 16189 - DNA, 606 bp, Zea mays
  Clone ID: LIB3279-229-Q6-K6-G10
cgatttcccatttcaaatccttcgatcgcacagcgccgcccgccctcacgcagctctctccgatggcgcgcacgaagcagacggcgaggaagtcgaccggcggcaaggcgccgcggaagcagctggccaccaaggcggcgcgaaagtcggccccggccaccggcggcgtgaagaagccggacaggtttcgccccggcaccgtcgcgctccgcgagatccgcaagtaccagaagagcacggagctgctcatccggaagctgcccttccagcggctggtgcgggagatcgcgcaggacttcaagaccgacctccggttccagtcctccgccgtcgccgcgctgcaggaggccgccgaggcgtacctggtgggtctcttcgaggacaccaacctctgcgccatccatgccaagagggtcaccatcatgcctaaggacatccagctcgcgcgccgcatcaggggcgagagggcctgattgctgctctgtcttcctgtttctgtagtgtctgaactaggggatggaatctatcgcttcttgtcctgcaatcgtgtactgatgttctaggcaaatcagtttggctgttatgaatgtgattcagtgctttgat

SEQ ID NO: 16190 - DNA, 649 bp, Zea mays
  Clone ID: LIB3279-229-Q6-K6-G11
gctccaagccagtgctagcccggccccttgtgtacgtgagagacggcatcgtaccgtagagcagcacatccatggctcagggaagtggcagtgctcgtggcagcggcgccgccgccgcgcttgcgctggtcctcctctgcgtgctcctccacggcgagctggccgagtcggcggtgtacacggtcggcgaccgcggcgggtggagcttcaacagcgccaactggcccaagggcaagcggttccgcgccggcgacgtgctcgcgttcaggtacaacgccaaggcgcacaacgtggtgcccgtgagcgcggcggggtacaggtcgtgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagcttattattatttttatttccctctccaaagtaaaagcgtcgcgtccttaacctggctgttggtagggcgggttaggtgtgtggagaccggccggcactatagagaactaaatcgaatgat

SEQ ID NO: 16191 - DNA, 645 bp, Zea mays
  unsure (1)..(645): unsure at all n locations; Clone ID: LIB3279-229-Q6-K6-G12
acctctcgggccgcaccgggaagatcatcgccgagtacatctgggttggcggttccgggatggacgtcaggagcaaagccaggacgctgtccggacctgttgatgaccccagcaagcttccgaagtggaacttcgacggctccagcaccggccaagctccgggcgacgacagcgaagtcagcgtttgccctcgggccatcttcagggacccgttcaggaaggggcagaacatactggtcatgtgcgactgctacgagccgaacggggagccgatcccgagcaacaagcggcacggggccgcgaagatctttagccaccctgacgtcaaggctgaggaaccatggttcgggattgagcaggagtacacccttctccagaaggacaccaagtggcctctcggttggccgctgggcggctaccctggccctcagggaccttactactgcgccgtcggagcggacaagtcctacgggcgggacatcgtggacgcgcactacaaggcctgcctctacgccggcatcgacatcagtggcatcaacggngaggtcatgccggggcagtgggagttccaggtcggccctgccgtcggcgtctcggccggcgaccagctctgggtggctcgctacattcttgagaggatcaccg

SEQ ID NO: 16192 - DNA, 670 bp, Zea mays
  Clone ID: LIB3279-229-Q6-K6-G2
gatccccaattcctccttcggatctcgcattcagcgcagcgcaggtgtgaaggaagggggacgcggaggaagatggggctcgcgttcgggaagctcttcagccggctcttcgccaagaaggagatgcggatcctcatggtcggcctcgacgccgccggtaaaaccaccatcctctacaagctcaagctcggcgagatcgtcaccaccatccccaccatcggtttcaatgttgaaactgttgagtacaagaacattagcttcactgtctgggatgtcgggggtcaggacaagatcagacctctttggaggcattacttccagaacacccagggtcttatttttgttgtggacagcaatgaccgtgaccgtgttgttgaagccagagatgagctccacaggatgctgaacgaggatgagctacgtgatgctgtgctgcttgtttttgccaacaagcaagatcttcccaatgccatgaatgctgctgagattactgacaagcttggattacactccctgcgccagcgacactggtacatccagagcacttgtgccacaactggcgagggtctgtatgagggcctggactggctggccagcaacattgcgagcaaggcttgaagcctaccttgaatatcaactgcgaactgactaggagctcccgatgtatcat

SEQ ID NO: 16193 - DNA, 661 bp, Zea mays
  Clone ID: LIB3279-229-Q6-K6-G3
cccacgcgtccggcgcccgccgctctcctctcctgccggcctgtccaacttcaaaagagcacgcgcttccgccccccgccctcctgtaccgctctccttccccgacgatggatcccgcagccatgtcgagatccccgtgctctatcgtctcgccgggctccttattaaccgccccacttctcccagtacgcctcgccgtccagccacgccgccgagtgcctgcttttattgcgccctccggcaggccgtccgtcgcgcggcgcgccgcggccggagacaagttcgaggccgagacgcccatagagaaaagtttccctcccttcccaactgtcatggacatcaaccagatccgtgacatcctgccacataggtttccgtttcttctggttgacagagttattgattacaaaccaggagaatatgctgttgcaatcaagaatgtgacaattaatgataacttcttcccagggcatttccctgaacgacccataatgcctggtgttctcatggtcgaggcaatggcccaggtcggaggaatagtgatgttgcagcctgaagtgggtggatctcgagagaacttcttttttgcggggatcgataaagtgaggttccggaagcccgtgatcgctggagacaccttgatcatgagaatgactctgat

SEQ ID NO: 16194 - DNA, 633 bp, Zea mays
  Clone ID: LIB3279-229-Q6-K6-G4
ctagcttggacggtggaccgagataccagccagctagatggcgcgagggcggtcggcgttctactggccgtggccgcgctcctcgcggcggcgacggcgagggcggcggacgacgacgacaagccgcagccctggcagtgcttcaagtcatgctccagaggctgccaccaccaccacgaccacgaccacgacaacggcgctgctgccgtggcggacttcctctccggggccgccgccaaggtctccgccgccgtcacccgcgagtgcaagaacaacagctgccatgacaacgcgtgcttcaaggacctgccggccatcacctacccgcagtgcgccatcgccacctgcctcagccatccgcaccgtacgtgcacggtcaaacgccccatcaaaacaatcgaggagcagcacgcgatattatactatactatagcagaaagaaaacggcgtgcttgaaggactgctgcgagaagtgcttcaccaatggcccacctgcgcctggcccacctgtgcctggcccgcctgtgcctggcccgcctgctcctggcccaagcccgacgccaccatctccgccaaattaagcccatgttgcatggatgtcttggtacacatgcctgaagtattagagagcac

SEQ ID NO: 16195 - DNA, 545 bp, Zea mays
  unsure (1)..(545): unsure at all n locations; Clone ID: LIB3279-229-Q6-K6-G5
atgagcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcattctcgccgagaagggagtagtagtattacctgatatctatgctaattcaggtggtgtggtcgttagctactttaattgagtgggttcagaacattcaaggtttcatgtgggccgaggagaaagtggacgatgaactagaaaaggacatgagcagtgcttttcaacacatgaaggccatgtgcaaatctttggtgctgccgaagtgtgtcgtgacattggaattgcgggtctagaaaaacaagctcattagatttctgaaaaaacattagaagttattagattggtagcatttttttaagatttaaaattttatagaagtcatcattttcgtttaaaaaaaaaaaaaaaaaanaaaanannnnannnaannaaaaaaaaaaaanaannnngg

SEQ ID NO: 16196 - DNA, 647 bp, Zea mays
  unsure (1)..(647): unsure at all n locations; Clone ID: LIB3279-229-Q6-K6-G6
ccgacggcctcaacaagacgaagaggaagacgggctcctcgcccaaggggaaggagacaacagggaccgggatatccaaggccgagagcgccgccgccgccgtcgcaactgcctcccgtgatcgtcaggctagccagatcaccttttcccaggacgggaccgttcctaccaggaaggcaacttcagtggctggggtggcaaggcagcgtgagcttagccataccgtcgagagtgagggggacagtaagatgaagaggcaggtgtccagtacgaaatccaaggagctcagtggtcacgacatctttgccgatcacgaagatcccaagcccaacaggtcaaggagatcagactatggcagctctgctgctcagtcaccagtgaaaaatgcaaacgtgagctccttctcgtttggagaggccgacattgacagcacagtgaaaacagcaaagaagaaagggtccagcaacttgtctactgatctgaacggcaagaccatgcccaagaaggattcagcgtctgcagagaaacagcctccgaaccgtgcgaggccgaaaggaatgagtgggagcagcaattntgcagacgggaaggcctcaacctcaacaaccggagatcatgaaggccgtcgtacccggcagcctcctggc

SEQ ID NO: 16197 - DNA, 298 bp, Zea mays
  Clone ID: LIB3279-229-Q6-K6-G7
ctatgtactcgatccagcagatgagaagatgcatgtagttatttcttggaaagcaaaaaattgttggagttgagaatgtgggagaccaagatgaggaatacaataagtatgaagagatgttcgtctttaacggtccagagagaatcaagcgtgtggaaaagaaaattgataagaacttaaaggcatacatgcggaaaaatggtagttcatgaaaaattgtatgaatcaaattgtatttgttatcatgtatgatcgactatgaattgtggttgccaattaatttaaaatctctctagtt

SEQ ID NO: 16198 - DNA, 262 bp, Zea mays
  Clone ID: LIB3279-229-Q6-K6-G8
cggacgcgtgggcggacgcgtgggcggacgcgtgggcggagttcttcaagcgagagtgcccgcaggccttcacctacgcgcacgacagcccctcgctcacccacgagtgcgccgcgccgcgcgagctcaaggtcatcttctgccactagagctcggagctcggagggcgccgccgccgtcaacaagtgtcgctagtagaggtagtaggatttgcggtgcgtgtgttgtctagtgtgtgctggaatagctgtggctgtgttcc

SEQ ID NO: 16199 - DNA, 662 bp, Zea mays
  unsure (1)..(662): unsure at all n locations; Clone ID: LIB3279-229-Q6-K6-G9
ggaaggagaaaacaggatgggatggaacccggagcccaatacgtggatgatggattattggatgggatgggatggagaaatttgggattaacactccccattaagtgcgttctcgggctgcttgtttcagtctcataccatacatgaatttgcaacgccatgtacttgttgatggcaaggtcaggactgacaagacctaccctgctgggttcatggatgccatttccatccctaagacaaacgggaactaaacgttgcctccgtcttcacccaattagggatgaggatgctaagtttaagctctgcaaggtgaggtctgtttagtttggccagaaaggcatcccctacctgaacacctacgacggtcacaccatccgctaccccgacccgctcatcaaggccaacgacaccatcaagatcgatctggagaccaacaagatcatggacttcttcaagtttgacgtcggcaacgtggtcatggtgaccggcgggaggaacatcgggcgtgtaggagagatcaagaactgggagaagcacaagggcagcttcgaggtcatcgatgtgctgcttggagctttttgctatgtctagttntctcctatttgttgtacaggaaaacatagaatggaattcaaatttggtggtcgcaaaagtgtggagac

SEQ ID NO: 16200 - DNA, 561 bp, Zea mays
  Clone ID: LIB3279-229-Q6-K6-H1
ggcgcgcaaccatcgggaaagcgcggtgcacttcgttcagtgcgcgccttgccggcgccggcggcgtctcggaaagcggcgcgggcgccttcaaggacctcaccttcttgcagtcgctgcagcagctgtgcacggggtcggctgggtccgcgctggcacacctggacctcgccaccccggcgaccttcgacaaccagtactacatcaacctgctctctggcgacggtctgctgccgtcagaccaggcactggcgtcgtcggctgccgtgcctggggtagaggcggacgtcgccagcctcgtcgccacctacgccttcgacgcctccgtattcttccaggacttcgcggagtccatgctgcggatggggaggcttgcaccgggcgtcggcaccagcggcgaggtccgccggaactgccgggtggtgaacagctccgaataaagtcatgcatgctcacgctcaactatctggtcgtccgtgcggcttgcattgctgatttgttatcagctaagtcaagccagtaagtttgtttgggttaaaaaataatcggctttggcatggg

SEQ ID NO: 16201 - DNA, 635 bp, Zea mays
  unsure (1)..(635): unsure at all n locations; Clone ID: LIB3279-229-Q6-K6-H11
cttgcctcaagattgtgtcgaggaagacattgctatggccttttctcaatcaggggaggtcaaatctgttaggataattaaaaattcatcaactggaaagaaccaagacattgcatttgtttgttacacaagtattgaagctgcaaagaaggttcttgctgaatttaaggagggaattgaggtaaaaggaaaaatggtcagggtatctgcttgtcaagataataataccctttacctggggaacatttgcaagggttggaccagagatcaggtgttgaacaccctaaaaagtattggaattcaagagtgtgagataagctttcccagttacaagggaggaagccgagggtttgcttttcttaagttcacctcacattactatgctagagcagcacttcgtcgcttaatgaaacccgatgctatttttggtactgatagaagcgctaaagtatccttttatcgaacccccacaaaatcatccaagagacttatacaggcaaaaatagtatacctggaacatgtccctctttcttgggatgaaaataaagttaaggaatactgtgaagaatatggggagatcctgaaagctgatgttttccagatatcanagaatatggaaaatgaaacaatttctt

SEQ ID NO: 16202 - DNA, 337 bp, Zea mays
  Clone ID: LIB3279-229-Q6-K6-H12
gatttatttatgcagaagttgaagatggcgtgggagaaaaagattggaacaacaaaagcagagttcttctgcaaggcatttgaagaaactcatgagaagcttgtttacaaagagctgaatttggatgctgctaagaagtttctgagcgcatatgagagctgatgatgaacagtaggtagggggggctcaaggataggcaggtgtcaatgatcctagaaagttgttgatgctgtcgagattttgatcattgacaaacttgtgttgtgtgcagacagtagacatccctttttggtcagctacacttcttttttcagagaaaaataaaaaaaaaaaatac

SEQ ID NO: 16203 - DNA, 649 bp, Zea mays
  unsure (1)..(649): unsure at all n locations; Clone ID: LIB3279-229-Q6-K6-H2
cccacgcgtccgcccacgcgtccgccggaagccgctaccgctagcacctccgatcgagtcggcgccatggaagacgtcatcaccgacgtgccgccgccttcccgcttttcccctgacgacctcgacaacttcgccgctccgccagcgcagcccacccccatcttcgtcgtttccccgaaccctagcccaccggccccgcgcctcctcgtcgtattcatctcccccacctccctcgcgctcctcgcctccccgccgccgctccacgcatccctgctcctcccggacctgcccctactcccgcacgcgcccatgcgcgtgtacctccacccctccggcgcgctcctcgccgcggcgcacggcgccttccccgcccaccgcgcgcgccgccgcgaaggctcttgtctccaggctccagccggaggaggtgctggttttggacgcggtccggagcgggacgtaccggggccgcctcgccgcggacgagcccgtggaagggaagttggagacccgcgcggcgcgcgcgcggggaggcgtgggggctgccaaggcagtccaggctctggtcccacccggcagcgtggtggacgggctcggcgccgccgtgctcgcggagtgcgagatccggngcaaggcggccagcatggtggtg

SEQ ID NO: 16204 - DNA, 638 bp, Zea mays
  Clone ID: LIB3279-229-Q6-K6-H3
cgagcgtccgccctccttcccttctcctcccctccaactgtttcctcaacctcccgacccaaccacggccgtgcccgccaaggcgccaaccgcacagcagcagctggggtgctgacgtgctgtgggtggttctgttgtccatggcgcggaagcatcagcatgttgccatatttaccacagcgtgcctgccgtggatgactgggactgcggtaaacccactgtttcgggctgcataccttgccaaggctggagattgggaggtcacgctggtggtgccttggctgtccaagggggatcaggagctcgtttatccaaacaagatgaggttcagtttgccggcagagcaggaaaactatgtgcggcggtggcttgaggaacggactgggctgttgccgaagtttgacataaagttctatcctgggaagttttcaactgagaaaagaagtattctacctgttggagacatcagtcagacaatatctgatgataaagcggatattgcagtgctagaagagccagaacatcttacttggtaccaccatgggcggaggtggaaaagcaagttccaaaaagttataggtgttgttcacacaaactatttggaatacgtgaaaagagagaaaaatggatacattagt

SEQ ID NO: 16205 - DNA, 516 bp, Zea mays
  Clone ID: LIB3279-229-Q6-K6-H5
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctaccgcggtggcggcggctaccgtggtggcggcggcggctaccgtggtggtggcggcggctaccgcggtggcaaccggggc

SEQ ID NO: 16206 - DNA, 544 bp, Zea mays
  Clone ID: LIB3279-229-Q6-K6-H6
caacattaaagtttgagatgttgaatggtaaaaacaattagtgacaatattgtttagataaaagtttgagatgtcagaggaagctgctgaaaaaggttaactttatctctggggctaagcttcaattcggcatctgcccattcttcagtcttaatgtcattgccgccgagtacaacagtgactcaccggtgcatgcacaccaaggatgtcatcactaccagcaccatcaacgactacaatagtgaagagttagtcttctactctacacgggagtaccacaccaaccaaaatggctcattgttgccaccaaacagaatgtatagcctattatgtctggcacttagggactcgatagctttaagggcaagttatgcactcaagtgactatcatagggaagggaggccttccaaggaaagaaggtgcttgttgtcggttgtgataacacctttccaacaataatgttcacacgtacattgtttgttcgtcgttgggtaaaaaactttgctatatctatttatttttaattatcgatatattattaat

SEQ ID NO: 16207 - DNA, 630 bp, Zea mays
  Clone ID: LIB3279-229-Q6-K6-H7
tagattcaacctcaagatgtgcagcacggattgcaatagccgtgagtactatgtcaatatcaggaaaaccctgcttgcagggtatttcatgcaggtcgctcacctggaacgaactggacattacctgactgtaaaagataaccaggtcgtccatcttcatccctccaattgcatggaccataggccagagtgggtcatctacaatgaatacgtcttgactaccaggaatttcatccgcacaatcactgatatccgtggggaatggctaattgatattgcaccgcattactatgacctgagcaatttcccgtcatgtgaggccaagcgtgttcttgagaggctgtataacaagcgggagagggaaagagctgcaaatagaggctgaagttgatacttccacaaacctggtgcttcataattccgccgcaggttatcacagatggcggacccgtttgtcataggcaaaggtgtcaacatgatgtcttccacagcctgttgcctagtgtttcatcagcatgatcattatgcagacagcctcgagaaatcccttggcagctcaattagttatgatgcagattaattttgtgccagtctccttatttttgtatgcgtcagatatttatattttgc

SEQ ID NO: 16208 - DNA, 610 bp, Zea mays
  Clone ID: LIB3279-229-Q6-K6-H8
caggcttgtgtcccaggtcatctcatgggtgagtgcttccctgaggttcgatggtgctctgaacgttgatgtgaacgagttccagaccaacctggtgccctaccctaggatccacttcatgctttcgtcctacgctccagtcatttctgctgagaaggcctaccacgagcagctgtccgtgggcgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggccagttcttcgaggctcgtgaggatctggctgcgctcgagaggact

SEQ ID NO: 16209 - DNA, 632 bp, Zea mays
  Clone ID: LIB3279-229-Q6-K6-H9
atctcgccttccgaggaaactcaccagcccaccacagacccgagcggaagaagccatgtccgggcgcggtaagggtggcaaggggctcggcaagggcggcgcgaagcgtcaccggaaggtgctgcgcgacaacatccagggcatcaccaagccggcgatccggcggctggcgaggaggggcggcgtcaagcgcatctcggggctcatctacgaggagacccgcggcgtgctcaagatcttcctcgagaacgtcatccgcgacgccgtcacctacactgagcacgcccgccgcaagaccgtcaccgccatggacgtcgtctacgcgctcaagcgccagggccgcaccctctacggcttcggcggctaggctgatgggctcctcgcgatgttctccccttctgcagatgcgacgttttctggccgtgcccacaagtcttgcggtcaagaaagtttcaggaactcttgttagttcatctctagctgtggtaggtttatctgaatcgtgagactagtaggtttatctgaatcgcgaggctagcaggcttacctgaatcatgaagcagtgatgaaattatgtgtgcatcggatgttggaaatcgaacttgtaatgcaatttgttactcttttgatgc

SEQ ID NO: 16210 - DNA, 566 bp, Zea mays
  Clone ID: LIB3279-229-Q6-N6-A1
aaactgatgagatagcctaataactgatagaaaacagttggttacaggcagaaaagagcagaagtatggagtcttactatgcctgcacaacttccccgcctaacaaacaaccatacaagtcaatcttatttcttatgcattcggtgatcctacaggctgcagcatttcccattctccgcgaaccaccgtggctttccgaatgaactctgagggagctgggcagcatttggcacttgtttgcagtgacggcttcaatgtccagctgctgaaggagcagcagcgagttcagcagtgaggatgaaggttgacatgccagcttccctgaggtgacgaatgtcgccattcatgagcctcagaaggtttctagaaacaaggaggctcaagccctcctccgactgttctctattgtcctccccatacatctgtgacagtatttctgctgggactcctgctccttggtgcttgatcctaagttcgaagtctatgagatgaaggttttcgccaatgctgttcttggtcagtttggaagagaatcaacagagccccagcaggagagaatttcaccg

SEQ ID NO: 16211 - DNA, 378 bp, Zea mays
  Clone ID: LIB3279-229-Q6-N6-A10
gagaaggaaaaaaaattagttttccccacaatttttaaaatgaagggggggggccgggcgagaaccccctggggggggaacaaaaaaaagggggcccccccccacaatcctggggccaaaactaagaaaacggaccccaatcgaacagccaagggccggggggtttaaaaaaaaagaacgaaaggcccttgacaccaaacaaggggtgaggccaaacccagggggcccccaaaaaacgcttggggggaccccggaaatggggaaaggccccgggccgaaaaccacctttcccgaaaggggggttaaaaaaagggggttgccccaccccggggggcccccccgaaattcaaaacgggatcccgtgagggtcccaatttt

SEQ ID NO: 16212 - DNA, 613 bp, Zea mays
  Clone ID: LIB3279-229-Q6-N6-A12
agggggctgggcgcgggcgcgggcgcgcccggcgtgtggcggtgctcgccctcgtacgtcaccaccagcatggccgggtcgtcggtggcgcgctccacgtgcttcctcgccgggcacccgcgcacggtgctgcacttgtagtagcccctggattggaaaccagatggcggcgagagaagagtcagattcgtcggcgcggatagtcggagacgacggtaaagaagagccgagcgccgagcgggcgagcgatgccgacaggtccgtaggaggagattttattttacagaagacttaccgtgggtagggggagcccttgatgggcttctggccgtacttcctccacgagtactcgtccggcgggatgtccgcgatcttggcgctgatcgccggcactctgatggtcctcttcacgcggtttttccttctcttggagcagtggcagcggctgccgttggtggtggcctcggagtgcgcgccggcgcatggcttccgcttgtggccggacagcggcggcttgccggaggacaccaggctgcggcccttggacacgctgccctcgccggccgtgacccgagagaataagacgtggaggtgacggacgtggcgccgcccg

SEQ ID NO: 16213 - DNA, 600 bp, Zea mays
  Clone ID: LIB3279-229-Q6-N6-A2
aaaaatatcgacaactttattgctattgtcaagtacttaaccttgtcaaacagttatataagcatggcgaagcgcgcctatcttgtcaaacagttatagcatgctaccgaggaaggccgcaggtccatatgtggtcgtttgtcatcatgtttcatttgatttggtgcctccattgtctatgtatggatgtcatatttctcatgacatgatcattgctagcttagccatattgttcatttgaccatagtactcaacagttaagtccgtaatattttagttattatttgttactgcgcatgttatctttccttaccatattgttacttggtgatggagtaaatgatgcccctgcgccaaagaaagctgatattagtataccagttgttgatgccattgatgcagccaggattgcttctgattttgtcatgacaaaacctagcttcaatgtgataattagtgtcgttcttaccagccagacaatttcccaaatgatgaagaactacactgtatgtgagaaggaaacctactgaaatagatttccaaaaaaacagttactttctttgatccactttcctttgcagtctatgatatttccattac

SEQ ID NO: 16214 - DNA, 607 bp, Zea mays
  unsure (1)..(607): unsure at all n locations; Clone ID: LIB3279-229-Q6-N6-A3
cagagaaacaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgacttcttncttggcccgccgaccttgcgcccggccgctcccttcttcccc

SEQ ID NO: 16215 - DNA, 627 bp, Zea mays
  unsure (1)..(627): unsure at all n locations; Clone ID: LIB3279-229-Q6-N6-A4
gtcttaaaaatatttatttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcacagctgctgcagcgactgcaagaaggtgaggtccttgaaggcgcccgcgccgncttccgagacgccgncggcgccggcaaggcgcg

SEQ ID NO: 16216 - DNA, 610 bp, Zea mays
  unsure (1)..(610): unsure at all n locations; Clone ID: LIB3279-229-Q6-N6-A5
ggcacaattaattattcatgaaaatggggaatcgaaacatagcaacagtgacacatgngatcgtctggtccaatcgaagtgaggcgcgtctcactcgtcgtcggcgacccggacgagctgctttccgacgttgcgaccgtggaagagtcctatgagcgccttgggcgcgctctcgagcccctcggcgacgtcctcgacgtaggcgagcgtgccgtccctgatgtacggcagcacccacgcctcgtactgcgggtagaggtgcttgtggtcgggctcgatgaacccctgcaggcggaggcgcttggagatgacggcggcgaggttgcgcacggcgtccttctccccgtccgccaggttgtactgcgagatgagcccgcagacggcgatccgtccgtgcacgcgcatgttgagcaggacggcgtcgagcatggcgccgccgacgttctcgaagtagatgtcgatgccgtcggggaagcagcgcttgagcgcggcgccgaggtcgggctcctccttgtagttgaaggcgtcgtggaagccgaacctggtcttgagcagctccaccttctcccgggacccggcgctgccgacgacgtggcagccggcgagcctg

SEQ ID NO: 16217 - DNA, 502 bp, Zea mays
  Clone ID: LIB3279-229-Q6-N6-A6
cttgaattgaacataataaggatgcaagtactacacgagctgagctcgtaaaaagggctacaccatcagccacagccacgggcacgggagcactctacactctgcctctgctgccaagggcgaaccggagtatttacacgctacaggcgacagcacggaacggaaaacgcaaagagaatgggagggggaatacaagaagcgaaaggggaaagcaagcgacagcaaccctgcactactactagtctactactggtcctacacctttttttttctcttttttttttcttcttctttgggttgctacccgtacacggaaggccacacggaacttgcagcacacagccaaggcgcgcccgacgggggcggtcaccgctcgccgggggggggggggccggggtggtttttaccggatcactcgaactccgggtagcggagcatcggcgtctcgtcggcggggaggggcacctgggcccggcaaaacgggcacgtggcgcgctcgtac

SEQ ID NO: 16218 - DNA, 526 bp, Zea mays
  Clone ID: LIB3279-229-Q6-N6-A7
ggtagtacaaaactcataaccatgtatgccttacattcgatgttccataaaaaaaataagtcttaatagcatcacggtttcaacgaaagtaataatacttcatgaccaggcaaacattgccatcatagattacttgttcacgcgacaactgcaaggatgtcaacaagacgagatattttaagcttccacgaggtaaccaacaagcaagcacagcaccagccagatagatcatttcttcttggcagcagccttcgtcaccagccagatagatcatttcttcttggcagcagccttcgtcaccttggctccagttgggtccttcttctccacactcttgatgactccgacagccaccgtttgcctcatgtcacggacagcaaatcgaccaagaggaggatactgagaaaaggtctccaccaccatgggcttagtgggaaccatcttcaccataccagcatcaccgttcttgagaaatttgggctccttctccagctccttgccggatcgcctatcaatcttggtaacg

SEQ ID NO: 16219 - DNA, 543 bp, Zea mays
  Clone ID: LIB3279-229-Q6-N6-A8
gctaaacaatacgcgtcctctgccacaaaatatcagttctggcgcaaatcaggaaataaaaagatcatattatagagccagtgctatgtacagtttgaacattcatcctagggagagcagctaacagtatcatataacaaaaatgttagaatcaattggattcactgccaagttcttgccatctggattctggagtgccagtgccacgtacagcctcggtatccttaggttagttcaggactcaggaagtcattacaggagcctgagaagtcatggggcctaaagtttaactgaaataattagagcaatgaatacacactaccctgctcttcgtgcaggagttcttagcactggattatcctgcaacattgggtggtaaacccactgattcccaaacccatgtggttctgcctgcacctgtatgaaattgttctgctgcatcctttggggggtgggtacttgatgttggtgattaatatccattccaaaatgattaccaaatgagagatttggtattccatccattaaatcaatgcctccttg

SEQ ID NO: 16220 - DNA, 632 bp, Zea mays
  unsure (1)..(632): unsure at all n locations; Clone ID: LIB3279-229-Q6-N6-A9
ttcttttttttttagagcaaagtggtttgggaccaattgcggaaatattcgcacggtcatcaggagttacacaaatgcaaacgctgatggattattgccttattggcacgtactcatggttttatcagcccaaagcctgatgaaacaaatttctttacaatgagtgcaatggctcgccacggaagatggaaaaccaggcacagcaaaacagaaagctacacaaggccaagcggccaaagcctacggaagggcgagatgaggctggtgcaacatggcgattccctgattggtaacggtctgacggagaaaagcgattccagagacgtcgattgcttgtcttgcatcgtggcgtgggtatctacagattgcacatcttctatgtaattgtaatgcaaactttggaaagtatatatgactagagaagttgtgcggcgcctccgaaggggttggtctgtggatgcattccatttactgccgggaacgcaccgaacccggcgtcgaggaaggggtttgctgcaggagcgacgcccgcgtgatgctgctgtggtggtccgaaggatttggttcaatcatcatggggcaaatgctgggctgtgtagccatggccgncatttgaactgacggtgggggag

SEQ ID NO: 16221 - DNA, 338 bp, Zea mays
  Clone ID: LIB3279-229-Q6-N6-B1
cgtcgatgtccgatagaagtaacaggtctactatgctgtttctacacactgtttaagcccagatagtataacagctactagtagctgaattataatgaacgacaacgattatacataaaccaaaacaccttacggcctaggttgagactgcaactgggatggctcgacaaggccttccaagacaacaagctgatcaagcagtgcaagcttttcatcctctagggccttcatttcttcatcttccatgctcagttctttgtccagtgcaaagttctcttcctccagcatcaggtacttcctccttaacgcacggtcggacgcgtgggcggacgcgtggg

SEQ ID NO: 16222 - DNA, 627 bp, Zea mays
  unsure (1)..(627): unsure at all n locations; Clone ID: LIB3279-229-Q6-N6-B11
aaaacaaacgtctattgtgatctgagatttaaaacaggcaccatagatgcttggggcaagtacagactgcaggctaaacatcccaatccaacaacggtcgagtgccgatgaagcgaagaaactacaaactaaactgcctcactccagggacgggacgacacttgcaaggaaactactcagaagacggcactaatctactgcatctagaaagtccttcgagaaaacccggttaggccgacaacgacgagattttttccctgactgcaaacacttggacagagtttcatccgtcatacatcactcgtcaccctcctcgtcctcgtcgttcacctcggacttggacttgtcggaatcaccagacgccgtggggtctccagactgcttgttgttgtaagcgtcgatcttcttggtgtactcagccttgagcttctctgccttagacacgtagggagccttctcggcatcagacagggacttccacttgtcaccaccagccttgccaatcagggagacttgcttcacattggggtgcttctccttgtagtccttcctgaactcctccatgaagacgaagaacgcgctcggaggcctncttggcttgtttgggtccttctcagccttggtcta

SEQ ID NO: 16223 - DNA, 621 bp, Zea mays
  unsure (1)..(621): unsure at all n locations; Clone ID: LIB3279-229-Q6-N6-B2
tttttttttttttaattgtaacgatctcgtttgatcaatcggatgaacagtttgcctaaacaagactgcaaagtacaggggattgtacacttggatgttgtttcttgtacttatagatggccaaaaagcacgaggtccgtgagcccggcacgaagcccgctttttgggcccggtccgagcccggcacggtagaataagcgggcgggcttggacaggaaactaggcacggcgggctagcccggcacggcccgtttacctctaagcccgtttttttacactaaaacgtgcttaccggcccgtttagcccgcttttcgacctgtttttttgtgctaaacgggccggtaagcccgttttagtgtaaaaaatcgggcttagaggtaaacgggccgtgccgggctagcccgccgtgcctagtttcctgtccaagcccgcccgcttattctaccgtgccgggctcggaccgggcccataaagcgggcttcgtgccgggctcacggacctcgtgctttttggcnctctataagtacaagtaacatcatccaagtgtacaatcccctgtcctttgccagtcttgtttagggcaactggttctccgattgatcaaacgagatcggttcatt

SEQ ID NO: 16224 - DNA, 590 bp, Zea mays
  Clone ID: LIB3279-229-Q6-N6-B3
agataaacaattcgaatgaattcaaatggtctccaacagactgctgctgaaacctgaaataatagcttctgtacaccttgggcaaaattagtcaaacccttcgtcccatccttgccacttgttcactacggaacggagcagtactatctagccgtcaacagcgcagcatcaacgagacatttacatatagccatcagaatggctgcgccacagcgatcagatgtctttctccagcggaaacggggccagacggcaacagctgcgatgcgaggagtgcgaggcgaagcagctagcagtgtggcttgtcgaccatgctcctggcgaaggcatagcggaatctggtggcgtacggcagccactctacggcctgcacggccttgcgccggctccccacgccccgctgggcggcctcctgctgcggccggtcgtcgacgacggcgacggccccctcgcgctgcgcccacgggaggacgctgtcggggcccacgcacgcctccctcgcgtaccgctccaccaggcgcggcaggaacagcttcttcgtggacttgcgcaccaccaccgtcgcctgcaggaactctcgcttggcgcgc

SEQ ID NO: 16225 - DNA, 436 bp, Zea mays
  Clone ID: LIB3279-229-Q6-N6-B4
aaaaacagttgctgtactcaacaacatcccctatcctacatttcaactctgaactcccaattcccaaggggaaggaagcagcagcagaagcttcaaaggcctctcaggtagccaaacctgacacggttgctattacacgtcttacacgtacacatacacaaaaaggacacatgcagctgaacatactcagcatttagccgccaaaaaaacaaaacactcgccaatgtgactgcgcgcccctcctctttcttcactgacctgtctacctctgactgaatcctacaggctcctcctgaggctcccagtcgccagaggcatgacacacacaggtcgcattggcaaggaatgggcgccaggagaattgcattcgccacaggagggcaagaaaagccttattcacagacacttggaccgacgccatgtcccaagatcggat

SEQ ID NO: 16226 - DNA, 621 bp, Zea mays
  Clone ID: LIB3279-229-Q6-N6-B5
ccgcccccaaaagcatggaaaccgtccagacttcagctttaaattgtcgatgcatacatactgtcacagtttgctgctcgaacaatccctaaacatctgggttaaagtcaaacttgccttttttcacatggctctagatctaaaagttgctacatgttcgaagctgagtgggtacagaaaacgattagtgaaccaagtcgagtcgagagttacacagctgagtgctttattttgcaggtggtggtggtgggatatcctcgatgacacctttaccgtcagccacatcgaaatagaagaaattcttgactggatcgcccttgcaggatatcgatttgatcacctgaccaagaataccaccaaggatagcacatacaggaggatgctccttctttccagctgctagcagtcgttccacgagagtagtaggaatacgagactcattcaaagacattttatcacacatatccttccttcgagccagaactgcatctatgtcagaaagtgttgtttcgccagggctgcgcccttcagataattcataatcctccagtactctcatagcaaagtataattttgccgtcttcttcggtagactattccaaggcacagagatagcttcct

SEQ ID NO: 16227 - DNA, 548 bp, Zea mays
  Clone ID: LIB3279-229-Q6-N6-B6
agctggcgtaacaggcgtgttttccaagccttttcgtgcgccgcaccataacaaatcatgcgagaagagaacgatggcgtgcacaacgggacagcgccgacggttgtcaccacgccacacgacgcgtgtcatatcatatacagtactatatttctgctctacgagtctacagggacctttcacctactagtactacgcgcaaccaaccgaacgcagctgtcgtagcgccgcgtttatgcacgcacggtgcgaccgtgcgaggagagccgtgtgtaggtgcaccgcattttatcaggacgtggaaatgccgaaatggaaacccgtgggctgccagtgtcgacaccgatcgattcacgcggtcctcggctgcaacttggatcggatccggctccatttgttcaggacgtccgtccgagcagctcccgccctggcacctcggatccatgcgaatcccgcccgtgacagtaccacgaacgccgggatccccacccaccctgcgctgcgctggacgttgctagctatgggtgcagcgcattccggtcaagccc

SEQ ID NO: 16228 - DNA, 554 bp, Zea mays
  Clone ID: LIB3279-229-Q6-N6-B7
gaatcggattccagttttgcgcgagttccaagtgttccaacatttggtcttttattccaaacaacagctaaaagaaaatggccgtcaaaactgcagcctcttatctaggctactactggtactggaggaacgagtacgaacatcagtgcttggcgctcacaagagccatgtgagcgatcagatccagaacccggttgctgtagccccactcgttgtcataccaagacacgagcttcatgaaggaagagctcagtccaataccagccttggcatcaaagatgcttgaccttgaatcaccaacaaaatcattggaaacaacatcctcgtctgtgtagccaagaatacctttgagtgcaccctctgatgccgtcttgatggctgctttcacatcatcataggaggcgcttttctcaatccggcatgtcaaatccacaacagagacatttggtgttggaactcggaaggccataccagtgagttttccattcagctcaggcaggacttttccaacagcctttgctgcaccagtggagctgggaattatgttttgggca

SEQ ID NO: 16229 - DNA, 570 bp, Zea mays
  unsure (1)..(570): unsure at all n locations; Clone ID: LIB3279-229-Q6-N6-B8
gatgatagcacaccgtcaaaaccttaccttatggaacacgacacatatatcatacaaatattggtttatcatctccccaaacttacgagaacatcacagtacacgaatagcaactgtaaaatgtacagaccgagctagcagtttgcaattatttgtaacagatccaagctaaatacattcacatttttttctttgccgccttgccgggcacttcctgatcatcgaacctgtcaggcggtggcaccggcaggtgtggcggattcacttgtcacggcctcagcctcccagaacgaagtcttcttgccagtcttggaaacagtttgcaggacggcgtcaggtgtcacattgcccttcacggtgaccttctgttccatgatgtctacgtcgtaggactcaacgccttccatcttgcccaggacccgcttgacagctccaacacagccctcacaggacatgccaaccttgagcacaacagtctgggccatatcgcgagaggggaggagggtcggggcggtccggcggtggtggtggaaatctcnctgccgcgaaggcgaatgcgaaggcgaggga

SEQ ID NO: 16230 - DNA, 599 bp, Zea mays
  Clone ID: LIB3279-229-Q6-N6-B9
ggataaggtttggtttccgctttccaaattccaaaccattagcaccatgtccacaacacttactgcttctacttctgataaatgccatcagcaatatacttataaataaaacaacatttggcatgccttgcaccggcggtcaaagttgcccactcgcacacgcactcgcgtacagtaacccaaaaaaaaccagagaggagagtacacagcttctaacttaggaaacttgacgactatagatctgcaaagaaatccgatgccggccgactcgaactctgtcctttacctgcctttttactccttgaacctttagaagaggttgccgccatgtctacatccatcacatcatcatcgctatcgtcatcgctgtcatcactaccagcttcagcaggttcatcaccattggctacctgtgggccactcaagagttcttccaagtcccagagcttcagcattttatcatgtgagatgctgcctaaatatttcttgtcgtttgacaaagcaagggcctcaatggggtattctgaatgttcagcaagtggctgttttatcctattaggtaggatgcccaccaatctgatcacaccatctgatgatcc

SEQ ID NO: 16231 - DNA, 543 bp, Zea mays
  Clone ID: LIB3279-229-Q6-N6-C1
accaagaaaatggttttcaattacagtagaattcagggtgtgatatcgtgtaatcaaacacaaaacaagaaaataaagagaagagaataactgtaaaaaaatcttacatattggaaccacatcatacacatcacgacagcgctaaagtttgtgggaactagttaacattccagaaccagcagatttcgctgcttctgtgtgttgcgctgaaggcctatgaggagggcgtgccaattgccaggccgtaatttgagccttggaaaatccgcgccttcaggtggctttcgaagacgtcggaagcgaagcgggagccattgaagcaaacgaaccagagcaggatcagcaccaatatgttgaataggcaccgctcccaccaatcgagcatgtagaggcccatggtgacgttgtagaggtggatcttcttgcccacccagctcatctcgccggccatcttctctgcggggtcagttctctccgtttcggggggtgggcgcgtgcgtgtttggtgttcctctggttctagctcaagtctgaattttccaa

SEQ ID NO: 16232 - DNA, 555 bp, Zea mays
  Clone ID: LIB3279-229-Q6-N6-C10
gcctacaaaacttctcatgaactgcacaattaccatgttctcatctaccagaagtttatacaaactttgtaatacaagaagcagaaccagctagaaagagaaccaggggggaatggatacggcggcgaacgaccggtgtagctgcaaaacaaagagcatacacaaaccagctgctccgtggaaagtgtttaccagtcacaatcgatatctcaccactgaaaacagactgtaaaaatccagcaccgcttcttcaaccagctcctccattactcccccttcgagctcctcggtgatgacaaccacctgcgccatcatcagtttcacccaccctcttgcttcgacctcctgcttcacaattctgtccagtatgatcccagcattatctctcttgctcaccacaaacatccgtgccccgtgtatccagtccttgagaatactccagacctccacccccagatcaggagatgaggtgcccctccatgttctggagcttcttttactccatgggagggcgctcagtaaggcgttctcaccgatctcaattagagcaacatt

SEQ ID NO: 16233 - DNA, 452 bp, Zea mays
  Clone ID: LIB3279-229-Q6-N6-C2
gaaggaacccaacaaagatactaaatcttcagatttaaggtaccagctgaaatcacaacattgcatatagtgacatgaattcaaaacatagctaaggcggtgtccaattcttggtaaactagatgtaaaatctactgcttgatatcagccttcttcttttgccacagcctgtccaaggagctgtctgcgtcaccctgagcacggacaaacccagagagagcaaacgttgtgaagtgaccatcatacaggccattcgcatccaagtggccaatgttgatctggacagaggcatggtccttggcagtgatgatcctgtttgtggccgagcacttcctggggacatagaggtccacagtcttaccctcctcgttctgcatggtgacagttgggggaactaccgcaagagcaactgggcagatcctgctcgtcgcgggtgctagggcggctgcggg

SEQ ID NO: 16234 - DNA, 612 bp, Zea mays
  unsure (1)..(612): unsure at all n locations; Clone ID: LIB3279-229-Q6-N6-C3
tcagatcaacagcctgttggtgcatcctaaaagtcagtatcttgtgttcgtcctccagcatctttccattcgtcttgtgcatcctccagtagtccatctgcttctcgcgcatgttggtctgcccattctggaggccctcttcaatagcgatcagctccctgtgctgtagggagttcaggtcctcacctttcagatgcctgagctgaatctgcatgttgtcgttctccttcttgactctgtcgatctctgcactcaggttcttgtgcttctcaccccacagtatcttccccgagttggtctggtacttctccaagatcctggacagcgaggtcctgggcgagcagtagtcgtagagcttgccgccgctggagaagatgacgacgccgacctcggtttcgcagagcacgccgatctcccgtgccttcttgaccagtccggcccggcgcttggagaaggtcacctgccggttggtagagttctcgatcctcttgatcttgatcttgccgcgccccatactgcgttctccactcccaaacagatccaagggcagcaagaggcagagctcagctcaagcaagaacccacttctttccacttncagcccacgcgtncg

SEQ ID NO: 16235 - DNA, 569 bp, Zea mays
  Clone ID: LIB3279-229-Q6-N6-C4
gagcccttaaaaccattttattgactgaaacaacccaactgaaccatagaaatgcaaaatgcctgtaacacattactgaattcaagattgaaattgttctgcatttacatgaaacaaaagaggggggggcattcctatgggaaaattcactacattaaatcaatgacaaatctatcatttactaaccagatacatctccgcaaggtatgtagggactggggaatgtacagatggggggtggtgactgttaccctgctatctataagctaaactccctgtgatcaggtagccaaggtgtgagcctggaaaaaaaaaatcctgcagactaaaatctccaaaagggagaaacaaccaaataccatcttatctgcctacaatcattttttttctagcctaggaaaacgtttggtctcgtcttgagccaatgcaccatctccttgtcaaggggggaattattcaacacggcatccatcattggactgccaaagtatctcggatcactcttgaacacccatatcctatcctttggccatggtctctgtgcctgtttttccatgcgtgataacatg

SEQ ID NO: 16236 - DNA, 503 bp, Zea mays
  Clone ID: LIB3279-229-Q6-N6-C5
aaaacaagattgggcccccggggaaataaaaaaagggcttgggccccataaaagcccccgacgtaaacccaacattaagctggcggtcccaaaggggccgggggggaaacggaaacaaaatctggccgggccccttactggaaagcaacaagttggtttcgcagcaccgggaaaaaacaaaactggaacgacttaaaagggggggtatcccggtaaaaaaaacagccccaaaaaggggctatcttcctttggcttcccctgggggaccgggaaggcgagtttttttggagctgtttttttggcaaactgggacccgggggaggccgggtcctcctaaacccactgccgaagctggcccccgttgcggggaaaaagggccccaaacctgcggatgtcggggggaaaaaaaacacccccgggccaacaggggcaccgtaaaaaaaaagttagtaagggccattgtttttttgttttgccgaaaaaaggggaggcgttcctgcccc

SEQ ID NO: 16237 - DNA, 617 bp, Zea mays
  unsure (1)..(617): unsure at all n locations; Clone ID: LIB3279-229-Q6-N6-C6
gaaataattcacatggtggtgatcttgcgacaacagcacccacagagtgctagcagactaaacatcagggctgagaacacaaattaaaccaaaaaaaaccctggcgaggtgggtggtcttgcgttgacacggaggaggatacgagaccagagagctgttttgcccacgggtgaggtttacaacgtgttggcctgagccttgttgaggatgacgccttcgtacttgacctggaaccacttcatggagtcctccttggtcaccctgtgctgaatcccgacgcgggacttgcacctcctgcggcgcgccacacggtagccggcacgctccagcacgacgtagaagtccattccgtagatgcctgttgacggatcgtacttgataccaaggtcgatgtgctcctggataccgaaaccaaagcacccggtgtcgctgaagttcctcctgagcagctcgtactccttgaccttgaggccgctctcaagcagctgcatggccttctcgcccctcaccgtgacgtagcaggcgatcttctcgttacgccggatgccgaacgaccgcaccgtgtacctngccttggagaagagggggtctggccgctgagctgctcgagcaccttt

SEQ ID NO: 16238 - DNA, 267 bp, Zea mays
  Clone ID: LIB3279-229-Q6-N6-D1
gggccggggggcggggcccggcggggccggggggccgcgggcgcggggggggggcgcgccccggcgccgggggggggcggggccgcgcggcgggggcgccgggggcgggggggggggccgcgcgggcgggccgggggcccggggggggcgcgccccgcgggggcgggggggcggcgggcccccgggcggggggggcgggggcgggccggcggccgggggcagggggcggcccgcggggggggcgggcgggggggggggccggggcgg

SEQ ID NO: 16239 - DNA, 590 bp, Zea mays
  unsure (1)..(590): unsure at all n locations; Clone ID: LIB3279-229-Q6-N6-D10
cagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactggagaccggccttcacggacctcgacaccgacttcttccttggcccgncgaccttgcgcccg

SEQ ID NO: 16240 - DNA, 603 bp, Zea mays
  unsure (1)..(603): unsure at all n locations; Clone ID: LIB3279-229-Q6-N6-D11
ggaggtacaagtacaccattttgtttgattgcacatcatgcttattacaagtttgatagatgcatactctagttcgtactttaacaatgggcacggttgaaagcaaaataaaatcgagccaggaggaaaacgacatcgtgccaatgtcagcatcacagatgtctcgagctcatgcttgctccgctttcggaggacctctccacttgaagttctcagcgtaggccttaggcctcagaagaggtgcatggcgtttccgaaccacataattccatccatgtttttcggcaaacgcctttgctgactctgcactgtcaaacgtaagtcctgcttcaccgacattagcatatggatccccagtagatgtccatcccatcaacgggttctcccacttttgggttgacaaaaaattaattttccacctcccgactttgcctgaaccttgctgggatgcagtcctagctggtgaataaattagaaccttacggcggagatgctcctcagggatgccggagaccatcccgatctccccgggcttgatctcaacgagggcatcagaggcctccgcggagagcatccgcgccggcgccggcgtcngcggcgtga

SEQ ID NO: 16241 - DNA, 600 bp, Zea mays
  unsure (1)..(600): unsure at all n locations; Clone ID: LIB3279-229-Q6-N6-D12
agacacanaaaaaagggttcacttcgtcggaaagcacagtaacttatttatcaccactggtccactgctatgcatgctgcagcgacagtaccaggaccgaagaaacagcctcacgtacagctaggcaatcaggtttattacgatcacgaacaaacaccacggcgccggtcagaaaggcaccagcgcaccagtacggctcatcactcctgccccaggagcgcgaggagcatgctctcgtagtcgccggaggtgtcccccgcgacggcccgctccagcggcacgctgttcctcttctggtacgcctccttaatcagtttgaggtccacctcagcgcgggtggtgatgaccctggtcagggagttctcatctgtgcctagccccgctatggcctgcctagccaccttctcaaagtacctgtcagggcaactgaagcaccggatgatcgcccgcagcgttctgaggtactcgtcctgggggtcagccttcagatccttgttgattcggtggccaaatgcatcattgtaatgattgaatgtagcaatcagctgaggtttgctcctagtggtgaggattctgatgatctcatcatcactgtaagcc

SEQ ID NO: 16242 - DNA, 579 bp, Zea mays
  Clone ID: LIB3279-229-Q6-N6-D2
caccaaaacacatgtcttttgtattttatactctattcaagtataaatgggaatcttaacaacctgcacatgactagtaaactatatgtacaactgactgacgcaaccgtttttgcatctgcaataaaccaagagagaaactcacagctaccacattgatgtgctaaatatattttttttaaagggcacttagatttatatgtccccattgggagtcagggtcatcatcaaacacggagaaatccgatacgtagacacaccactttttccttggggccaaatttcagcgattgaaatcgccaaactcagagcaaacgggcacttcacacattgagttgcgctactcctataccagtcacattcacgtggatggcaatgttcaaaatgttcatcttacaaaaaactcgtgcgctgtttaaaccttttataggccgtgaggcactccctgaaaaccatggtttcagacgaccatgtcgtttgttaaaatgctgacatgaaagcctacctcttcaaccttaatcttgcatttcaacatcggtggattcaacctccatattgtttgattgaatggaggcaacc

SEQ ID NO: 16243 - DNA, 574 bp, Zea mays
  unsure (1)..(574): unsure at all n locations; Clone ID: LIB3279-229-Q6-N6-D3
ttatttttttttttttttttttttttttttttttttttttttttttttttttttttttttttttcttttttttttttttttttttttttttttttttttggcccagaaaaattaaaacagggtcaggttcaggaatggaaaagacgaggcattaccccttattcattggggccaggcccaaaaggtaaaaattccaaacgggcccatcaggttcagactaaaaaaatcccggcacaaacgggagggaaacccccctcctcgcagccccgggggggggaacgacgtttccgggggcccgggaccccggtaaaaggaacttccggggggggcggccgggatccccgtcctggatatggaattcggggacaaagcccttgtaaacgagggtggggacagggaggcccaaaaggcccacaacggggagggtggggggggcccaggggaaattgaacccgggggtttggggggcggggttccacttttggaaccaccggttttggggcacctccatgccgccacccaattcccccttcctttctttctttnatcccccggacgcggggggggacccggg

SEQ ID NO: 16244 - DNA, 475 bp, Zea mays
  Clone ID: LIB3279-229-Q6-N6-D4
acacgcactgtaacacaattcttgacattaacgaacaaatcggccacagcattgcgcgcaagggccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgagggggcgattaggccctctcgccgcggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcagttttgaagtcctgcggacgcgtggg

SEQ ID NO: 16245 - DNA, 561 bp, Zea mays
  Clone ID: LIB3279-229-Q6-N6-D5
gacagcaataaatgatacatgaaataaacagggggcccatcaggcaccgatgactaaaacagggggggcgaaaagatggggcaacggggggaataattcttacagatgatctcaatctacaatttatgtatcttataaaacatttggcagtccttgtttacacagaatctacactagttcaccgggcctcgtcttcgagattgcggaaaccaggggggagggcatcatacagtttcttaaatttgccgaccaaagctttttcaccttcgggaggatcctcgaacttttgagatactaggcgataaaatagatcgcccaaacggggttttatgacaccgtatgttatcttttggccatcagtaccagctgcccgctccacagcctgatttgccaatgtgttgaagtgaataatattgcgcatcatccaaacggatttgtagaatgggcagaacttatcatatggggtaaatgcattttgggccaaataatcttctctcagtagctttgctgtctccagtgtaatcttgtcagattctgccagcgcatttttaccaacaagct

SEQ ID NO: 16246 - DNA, 593 bp, Zea mays
  Clone ID: LIB3279-229-Q6-N6-D6
atccaacagtccaacacagttcagctcatcggttgccacaggtgcttaatggcgagtacaccactgatcacatatcaggcgctcttattattattatttcacgatgtctcgggatgttattctagcctgctggtgagtggtgacggcactcccaggcgcccccgaagtccagcgaccattcgtttcagttcagccctggagtccgatgatcccacaagcaacacggccgccagcgtttccggtgctcttgctgagctcgtgtccaccctttccaagatcatcggggtcagcgtgaacaacaacagctctgccaatgattgagtttggcccagtcagtgggatctggctgtcggtaacattaatgtttgcaacaccatctgctccagctgtcacatttccaagatcaccggcatggcggttctcatcttctggtgctccatgttccttgctcgcaggattgtagtgtggtccagttgacatgcagccattggtggtgtcaccaagcgcatgcacatgaaacccatggaggccaggcttgaggccagagacacttccggtgacagtggtagggccatctcccacttgggtgaaaa

SEQ ID NO: 16247 - DNA, 619 bp, Zea mays
  Clone ID: LIB3279-229-Q6-N6-D7
aaaaaaatgtgaagttagggttgacttcacgttttttataaagcaataaaaatggtgcttcacaaacactactttccaataccctcataaatttaggggataattacccaccatgaccaccgattacacaaagaaaatgcatcattcttttcacttttcctccagttcccaaatgtagcgcaggcacaacctttcgtctatcccacagcgcagcctttcgtctctctttcaagcgtagccttccaatctcctctttccatagatccacctctgagatgttcatgccgccaggcacatcacaacgaatgacctcaccaaagacgttgcaatccacacagcaatccatgccgcaacagcagggctcgtggttggtggcctcggctcgtgtggcatggtgagattgattggcacgcttgcagttggcctcaacaccgatgatggtcttccaatgatgatagaaacttcacgcgctatcggggtacaagagacttttcttggtcgttcttttttgatggattggagtcatcctcccaccgaaggcttgaagagataaacatcttcctcatctctgagatcacgatgcacttcggcaaaaaaaaaaagcattgtatgtttacca

SEQ ID NO: 16248 - DNA, 552 bp, Zea mays
  Clone ID: LIB3279-229-Q6-N6-D8
cctcaagtcacaaactcaactatgaatatttgctgtcgaatcgggtaacatatatatacacagctaagtgaaagaagaaaaaaagaaaaattggaagccaacgacacagaaatttaggagcagctaactagacatcacacacccaggattatgagcaagcaacgtctctgacatctgggactctaaacgcaaccaaaacaatttcccatgcaaatgcaaatatgcaatgaaaaccagtctccagacggccttatttcatggtaccatctaaaagccgctaacctgtgaaatgaatatccgaacgacccaatgtccatccatgcatcgcacgagtcgttctagcgggtcctgcggctgttggccggtttcaacggggacaaaggcttggtctttgccaagtcgaccaggtccttgaagagcgagtcctcaggtttggcagggcgggacgctgccggccgtgccgtgctcctctcgttctcgctgctccgcgggttcagcgagaggccttcggtctgtgtcgtcagtccattgtacccgccttcgttgctcccg

SEQ ID NO: 16249 - DNA, 603 bp, Zea mays
  unsure (1)..(603): unsure at all n locations; Clone ID: LIB3279-229-Q6-N6-E1
gcaactgaaaacacaaatcttgtagccgaacaagaacaaccgggatggacatacagtattttttcctgggcgggttgtctctctaggaaacaagcgcccatcggaaaagcaactaagtttctctaagccataattctaactgcctgacgaatgccgcccaattcttcagaaagctaggactgacacaaatgccacgaaaccaagagtgacagagaagccgtcagctatcatcttggacccccggctgtatcgcggcggcgtctgactgctcaccgatggtgacggtatcatacgtggtgtcgtcggcgttggcgtcgctggcgtggtgagggtcgctggagcactggagttggcgcttgcgtgtggagtgaccgccggtggcggcggcggcggtggcagcggcggtgatggtccatggggaagaagaccggcaactgcgcaggcgccggtggcgggcgggaggtcgaggcggcagagccgaggcatggccatcacgcgcgtcatgttgacggcgacggnggccgtgctggggttgctgagagcctggcagaggcactgcggctcgtcgtgcaccatgctgcccaggttggcgcaacaagtgtc

SEQ ID NO: 16250 - DNA, 562 bp, Zea mays; identical to SEQ ID NO: 13971
  Clone ID: LIB3279-229-Q6-N6-E10

SEQ ID NO: 16251 - DNA, 557 bp, Zea mays
  Clone ID: LIB3279-229-Q6-N6-E11
tgctcggcgaggatggcccacaggatgtacgccgcctgcatcgcgacgaagaccgtgttgagcgcggcgaggagcgagttaagccagggcctcgcggcgatggcggcgtgcatgcccgcggtggcgaggaagcctaggtcgagcggcggcgcgtccggcttgaccatggggatggtgtactcgacggccatgaagagcaggaggccgcacccgaagagcgcgggcgccgggtgccgccgcagcacgcccgcgacgcccgccgccgagcaccactcgggccgcgtccacccgtccgccaccgcgcccatctcctccgtccccgcgccttcgcccagtacctggtggaccttcgcggctcggtcgttgcggcggcgggttgtggtggtggtggtgccggcggcggtgaggctgggcggcggcatgtatgtggggtggcgtcggtcgggggatgggttggcaaccggatgggtgcgtgagtgcgtgcgcgggccgtgcggacgccgaggaacgcgcggatctcggtgttttttcgggttttttttatagttttgagaggg

SEQ ID NO: 16252 - DNA, 582 bp, Zea mays
  Clone ID: LIB3279-229-Q6-N6-E12
aaactaacagctgcattcttgttatattttttggtcatttcttacgtgcatgctatacaaaagaaacttctacagtagtacaactactcacgtttttttacttcgactttgacagacagaccacgacgccgacggcagctgcagccagtagcagatgctgctagagaggcagcagccttccatgtgagtcaccgagtccccatcaggggccggccagcgaacctagcgaggctggtggatcacgcgaggagcgctgctcttggggctgccggcgtacttggtcggcttctcggagtgcctgggtttctcccggaacccccgcggggcgtcgccgctcttcggggagcccaagttcagcgccttgagcaccgaatctgtcttaagggcggcggcggcggcgggggcctgctcgccgtagaagaggtcctcatcctcatcgtaggcaaggagggcgaccaactcgagctgctcggctatctcatccaggtgggcgtgctcgcgggaccagtggtcgcggaaccaggcggtggtggtgatgaggtcccaccactgcggcgatgagtcctccacctgcagcagcgc

SEQ ID NO: 16253 - DNA, 601 bp, Zea mays
  Clone ID: LIB3279-229-Q6-N6-E2
ggccattccaagctcgttgattagcaaactacaggcgttacatgaaaagaaaaagtaccaacgatatcattcagacagcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctctgggctccgcccggcatctcgtcgtcctcctcgtacgcctcctgggcagcgtgagcttgcttcctgcgcatctcttcctcgatgttgttcacatcatgcatagtcgtctcctcgcattcatctatctccatgtctgtcagcttggatgaaggccttggtggaagtactgtctcgagagctttgcactgctctggtgccagcgagtcaggga

SEQ ID NO: 16254 - DNA, 463 bp, Zea mays
  unsure (1)..(463): unsure at all n locations; Clone ID: LIB3279-229-Q6-N6-E3
gggnnnnccgggggggggggggggccccccggggctttctcctttggnggncnncncnccccnggggggggcccccccccngggncnncccccccccccccgccccccccncccncccccccccccccccccgggggcccccccccccccnccnccccccccccccccccccccccnccccccgccccccccccccccccccccccccccccccccccccccccccccccnnccccccccccccccccccccccccccncccccccccccccccccccccnccccccccccccccccccccnccccncnccccccccccccccccccccccccccccccccccccccccccccccccccccccccnccccccccccccccccncccccccccccccccccccnnccccccccccccccccccccccccccccccncccccccccccccccccccccccccccc

SEQ ID NO: 16255 - DNA, 611 bp, Zea mays
  Clone ID: LIB3279-229-Q6-N6-E4
acaaagaaaacaatactgtcataaatggtatacatacttcaatggcaaactcatgcttggcaacatcaaccttgttgaatgtcaggactagaggaaggcgggttttgtagagaatactacaggcataaagcatgttgctcataaaagtaacagggtttgttgatctcggagtgtcaacaacatatgctacaactgttggaaacgtcgatgcaaaagcttccgtaatgatagctcctgaagctgaccaagtgaagatctcaatctgaccaggagtgtccaccagtacataatccaattgttctgcacgtctttcaatgacagatacaacctaagaatgaatattaaatgtcatatacctgaacaaaataaaggtaacagaaatgtgcatttcccatataccaccataagtacaatataatttgcagcaaagttaaattattcagtgtggcaacagataaatcccctggtgttcctttgtggactgaattgagcacaatctccatgaaagcttgaatggaatggtaagagttgacatgacatccagagtgctttattagcacatttaaccaaagtcatcattcacaaagcacatcagttcagtctttgatccc

SEQ ID NO: 16256 - DNA, 543 bp, Zea mays
  Clone ID: LIB3279-229-Q6-N6-E5
atccgtaacggttccctctaaatttttcccattatatcactttttgcgtcacataatcaatatttcaccccctattttttcatcttccgcaacggttcccctatattatctcatatatcccactacaactataaaatatcattatctaacactatttatcttttattactatttttattaactattaaatatgaaagcactgtgcaaggagacgctacagtgttccccttgatctgggggaacgtgcgtgccctctcctaaagctgcagcgtatagagcgctctttagtgttagccgctgcgagcttaaaggcccctacgtaagaggagagggcacggtagcgcaagttctgcgacccgtcttatctgtagaccgacgccggcagaagaagtagaaatgacgacgggaagaccgacgctggcgaagcatgtggcgccgccgcggtcgccctaggaagtaggaagcgccgtcggggtgagagaaagtacagaccccttttttccaagacagcactgcggagttggagacatgcttgtgtagcga

SEQ ID NO: 16257 - DNA, 602 bp, Zea mays
  unsure (1)..(602): unsure at all n locations; Clone ID: LIB3279-229-Q6-N6-E6
aaaaattaacaattttattgatatatttgtctgtgtcaatcaataatacattctgatggacctatcttgatatctgatacaaaagtttaaaaggaaacatcgacaacatgtcaccacgtcccacttgagttctcgatattgaaatgcaccttctactcatattacagacaaacgcaacatgcgctcaaggatgtatccaccatccaattacgttgcaacctaacaattgctgagcgaaataagctggtcaactacagcaggttcagcgagggtgcttatgtccccaagttcatccagttgccgtgcagcaatcttgcgcaaaatccttcgcatgatcttgccactccgggttttaggaagtcccggtgcccagtggatcttgtcaggagctgcaaatgccccaatctggttgcgcactgtcattatgaggctttttcgtagttcctcactatacggaacaccatccaccaaagttacaaaagcataaattccttgacctttgacctcatgctcaacaccaacaacagcagcctctgcacactgtnggatgtgacactaaagctgactcaacctctgctgtgccgattcggtgtccactgaca

SEQ ID NO: 16258 - DNA, 638 bp, Zea mays
  unsure (1)..(638): unsure at all n locations; Clone ID: LIB3279-229-Q6-N6-E7
gtcgaacaaaacatatcatacaaatccacggggggttttgttagttccaaatttccgaattccagtcacttcacccacagcagcgaggaagtaaaagcttattccacgactcatctagcaaaacacggtggcaagcctatccccaaaagtccatgtgcggaggagtaaaccttagccttgcagtgctacaccaaggtccgaaacaagatgacacgcaaagctggcagaacctgagtagcagcagcagcagcggatctaggcgtcatcgagggcaaggacaccaggtagagtcttgccttccaagagttccaagctcgcaccgccgccggtcgaaatgtggctcatcttgtcggccagcccagccttctcgacagcagcaacagagtcgccgccgccgatgatggtagtgacacccttcgtggttgtaagctcagctagcttcttggcaatcgcctcagtgccagctgcaaacttctcgaactcaaacactcccatggnggccgttccaaataacagtcttggtggtgtccaatgcttcgttgaatgttttggtggcatcagggccaacatcaagacccatccagtcatcagggatagcagtggcagggacaatcttgctctcagcatcagctgcaaac

SEQ ID NO: 16259 - DNA, 602 bp, Zea mays
  Clone ID: LIB3279-229-Q6-N6-E9
agttcaaaaggtcacttggatgatatcaaattcagaagtgtgcataacacatggtaatggaacgattgagagccatagctacaaaactctggtttcacatagaactaggacacaacagatgaactaggatgcctaatgcagcacttagatgatgccgattttgttggccacatcaagagcatcatagtcgggagtcagcttcacgtaagccttcttcttcccatcaggcctgatcaaggtgttgaccttctttgcctggatgtcatacatcttcttgacggcagccttgatcttcttcttgtctgccttgaggtcaacaatgaagaccagagtgttgttatcttcaatcttcttcatcgctgattctgtggtaagggggtacttgagaatttggtactgatcaagcttgttccttccggtagtgctgattcgtgggtacttggggtccctagccttcttcagggtcgtggggcggtgaaatgtcacagacgtgcggatcttcttggtcttcttcttggctgccccagacttcacagccttggcaaccttcaaggcctgggtcttggcatcacccttcttggcaggagcagctttaggagcca

SEQ ID NO: 16260 - DNA, 461 bp, Zea mays
  Clone ID: LIB3279-229-Q6-N6-F1
aaaccaaatgcaccatttgtgaagaaacccaattattgcaaaaaggctctcacaagcaaactaagcataaaacataggaaaattgcccggctgcaacaaagggcagaatacaacacaccctccgtccatgttttggggacccatgcctccacgctataggacagccacgagcgtaaagtgatcaaggtgtccgcccaaaacgaatgctggcaaacttatcctacatgaattattaacgtcgtggatttgactggcataaaccggaccagatcctgactgggctggaccggcagcgaactgctgttgtttggcatcatttttttccatttaagcaccgccggagccgtacttctttccgaagaagaagatctggagctggtcttagccagaacgcacaccagcgccagcaatggcacgaagaatgtgagcaccaccaccctataacatggacttggggccaa

SEQ ID NO: 16261 - DNA, 501 bp, Zea mays
  Clone ID: LIB3279-229-Q6-N6-F10
gggatcataggatagcaaaataccattatagcttaacttggtcataaaaaccggaggagcctgacgggtgatcacaccccaacaactttcccaaggttttacaggcccaaaactacccccgaccctcatgctggggccccccacgaatctagagcccccgacaattttaccattgggtcaaaatccatgaaagaggggaatctataggcggaattgagggggggatcccccccgcgacaagggaggcaaactactttttggccttcctggccaccccctttctggccggggcgggaacaacaacaaccttttttgggggtgccacctttttaagaaccccccctgcctttccctttttgggaagaacaacccccttcttggctgccttggcgggggaggccctggcggagggcttggcgaccctgggagggcccccccggggcttgggccacaccggggcaagaaccacaagcttggccctggccttggccctgggtttgg

SEQ ID NO: 16262 - DNA, 616 bp, Zea mays
  Clone ID: LIB3279-229-Q6-N6-F11
ggttgaaaacaatatcgctaccctcaaaatttaatggcattagactatgacaatatgcaaattccagtgaccgtaagaactgatacccaaatcatccctatcaaaccctaattctcatggcacaaaaaccatcccaatcaagttctgaaactcatgacacacaaagaaaaaactgagcacacaaaaagaaatcgagagatggccggcgggtgaggtggagggacgaatggagctgcaccaccttgttggaaccccacgaccttatccagcctcgctcgcataactggagacggcacgacatggagacggtcgttcgggtgtggccgacgcggagccgggacgacgacgaccctgtcgccgcgtgtggggagggctggtggaagcgatgcagggacgccgaggaaacttcaactcacatcatcactgtcgtcatccgactcatcttcagaactgtcctcatcgctgctgctctcttgcttgaccgtcttcgaaccattttttgcaactgcagccaagggtttagcagcaggcttctttgtaggttcctcatcagattcaaaggtctcgtcgctagtgtcatcatcactggactcttgtttagcaatcttgggagcag

SEQ ID NO: 16263 - DNA, 543 bp, Zea mays
  Clone ID: LIB3279-229-Q6-N6-F12
gatggcaacatgtcatgttcaagcagtagccacatgttcaaacagtattcgtcagttcgagtagactagttgaggctgaatctgcacttcagtagtgagacatcctacaggagttcatgcagcacatgctacgttttttatatacacatcataacacgtttccgcagcacatccaaaacaccgaagggccagtttgcaaattccgcgctcctcaatcaacaaaacagctgcttccgatttattggcggtctagttccattggaaattcacttaacagcttttatgtttgcgagggcgggaaaaacctcggggactgaaccttcgatagctgacctattagccttgagagatggcactagggcgtaaacctcttcaacgggctcaggcccaatgtttgctatcatgcatatctctccatcactgaccccacattttttaaaaggttcaatggcttgtttcacaaagcttgcagtggggaaatgatttccatcttttgaatactgaaaagctttgtcaaatgactcaggaattttgatcttgggg

SEQ ID NO: 16264 - DNA, 483 bp, Zea mays
  Clone ID: LIB3279-229-Q6-N6-F2
aaagcttaaacgcccttccattttttttaaaacgatcaaataaacgggggtccgccccaaagttgcatagcccaaaaaccttagccgttttcacattggaatcaacgatcttggggaaccaagaagaggggctttgggcattcccaaacacatggggctctaaaagacaggcggactaacggggggctaaacctaggaaacaagacgggggcgaaggccttttttccagggggcagcttaagttgtcatcgtcatcgacgggggaagccttggacaacccaccctttttggggaggaggggctgggggatgttgggcataacccccccgctcgcgatgggggcaccaccaagcagctgggtcagctcctcgtcgttgcccacggggagctggatgtgacccggcacaatgcgggtctttttgttatccctcgctgggttcccagcaagctccaggacctgttgaagcatcgcataaaaacaaa

SEQ ID NO: 16265 - DNA, 517 bp, Zea mays
  unsure (1)..(517): unsure at all n locations; Clone ID: LIB3279-229-Q6-N6-F3
ggggtgggggggggggggggggggcctggggggggggggggggggggggggggggaccgaggggaagagggggggatgggggggaggggggggggggggaaaagggcaacccgggggggagggggaagccaaaaggggaaaaacagaaaaaaaaaagggggggaaaaaaaaaaaaaaagggggggggggaaaaagggaggaaaaaaaaagaaaaaaagggggggaaaggggggggtaagaaaggggaaaaccagggggaaaggggggttggaaaaaaggaccaaggggggggggggggaaaaccggggagagggggaaaagggggggggcctttacccccggggacggggaaaaacggaataagcctccaccggggggcccgaaaaaagggaaaaaaccggacaaacgggggttgccgccggggttaaaaaaaaaaatttttgggggtcggggnncgcctataaaaaaaaaggggccaaatcccgcttccggcaaagaaaaaaaaagaaaaaagaaa

SEQ ID NO: 16266 - DNA, 592 bp, Zea mays
  Clone ID: LIB3279-229-Q6-N6-F4
gtatataactatcagctcttaaacgcacaaccaatcaaaccaagcaagtttgacaacaactaatctcacaaaccaggtgatacgacacagcacgctcgcacagggagccacaacatacaaaggtagctgctaaccccgagaagactcaggtccgatgaaaataaacgtcgcaggcaaatctgccacacatatctcgagaaatgacgggggcataacttgagactagataacaatgaggaacttgcggaacctagaagcacttcctgtggacgattgccgggccagactcatcatactcctccttggatatccacatctgttggaaagtgctgagcgaggctaggatcgaccctcctatccagacactgtacttcctctcaggtggtgcgacgaccttgatcttcatgctgcttggtgcaagggaagtgatctccttgctcatacgatcagcgataccggggaacatagtcgaacctccactgagcacaatgttgccgtagaggtccttcctgatatccacatcacacttcatgattgaattgtatgttgtctcatggattccagcagcctccataccaatcatggatggctg

SEQ ID NO: 16267 - DNA, 603 bp, Zea mays
  Clone ID: LIB3279-229-Q6-N6-F6
gaagcatgctgatgcatgaatatttcttccaatgatccgtcagataacaaggaccaatcagtacaaaatacgtctaaaattaccccacacacacacacaagagagagataaatgtttattcctttcgaaacagtgtcgtgatatgctaatatgaatatcaggactccaaagtgtatgtcattgcatttccaaatcttaactaaagcacacagtgtcagtggtcagttcatcaatgcatgcagtatgctcgaagaaaaccgttcagcctccctgcacagcgcatacttcgtccaaatacattcgttgcatcacattgtcatctggcgaaatcacttgaccaatggcagatatcctctcacatacttaactgacaagttttacagcttccgttccagaaacaagtatatcttccacgaacggagtggtcttccatactttcaatcctagtggcagtctaccgtttccagaatctgaacttgttgagtcatcctctatacagattgccatgtaatgagaactgtttagttcagcaagtgcaaactgccaattctcggacagacagtcatggatagagtcagaaccgttcgatacttttggtgccac

SEQ ID NO: 16268 - DNA, 600 bp, Zea mays
  Clone ID: LIB3279-229-Q6-N6-F8
aatgtcaaattttaatgccattcacaaacacaaggagatattagaggtctaatattctgaacctgctttacatcatggtgacctcatgtggaggtgacaagagttgagaaataacttttggacgcgcgatggtttacaaaaggatgtacggtacacttttcatagaaagttggataggaataagcccttacaatgcaaacataatccctaacacaaaaattaggctgggtatttgctgtatcgttgtacccttttttcccacagcaaaatccaatgcaattgagaagtacatcgagatactgcagcttgggtaatatgcacttcttgctggtaccccaccatgcttacgaacaaaaccaatatgtggcaggtatgaggtatcagcttcaagcattcctttgtttcaggttgactgcattacaacagtgcttcgaggtccatctcaacgaaagtgcagggatccggaatgccaaatttccttaggacctcagcatggacaattcctaagtagccaacttgcttgccatcacttgtcacaattttacattgtcttttcgggaagaactcaggttcatctgtaggtacatagtaattctcgcc

SEQ ID NO: 16269 - DNA, 606 bp, Zea mays
  Clone ID: LIB3279-229-Q6-N6-F9
acaacagaaactactgcgaatgagcttgtattatccaaaattcaggaacaatcactgttactaccagaaatacaatcacccacagacacaacatacgtagcatgcttccgagcgcttcattgcagaagcgatggattacacggctattgcagcaataataccacagaaagcatcacacagagacatgtcccctaaccagtccccgactatgaagaggcgcctagcctagcctccgaagccgtagagggtgcgtccctggcgcttgagcgcgtagacgacgtccatggcggtcacggtcttgcggcgcgcgtgctcggtgtaggtgacggcgtcgcggatgacgttctcgagaaagatcttgagcacgccgcgggtctcctcgtagatgagccccgagatgcgcttcacgccacccctcctagccagcctccggatcgccggcttggtgatgccctggatgttgtcgcggagcaccttccggtggcgcttcgcgccgcccttgcccagacccttgccgcccttgccgcgcccagacatcgccgccgcctctctgacgcggaccaaagactgggaatttttctggtgtaggggagcggacgcgtgggc

SEQ ID NO: 16270 - DNA, 407 bp, Zea mays
  Clone ID: LIB3279-229-Q6-N6-G1
aaaaccaccatgcatatttttaaggggttttggaatttgaaggcataaaaactaatagttaatggcaaaaattagtggaaaatatttattttaagcaaattagtaaaaagttagctagctaatttaactagcaaatttttagccaactaacttttagctatggggcattaaaacccccccaaaaaaaaaaatcggaaaaaatcaccctttataatggttaatattaacagccgcctcctagcagaaaggggcattccaccatttttagggagcataataccggggccaaaactactacggaactatcctactgtttccgggaaaaaaaatgcctaatgtcccacccttgctgattgggggtattttctagccccaaaatttaaacactgttctaccgaacccgtggg

SEQ ID NO: 16271 - DNA, 527 bp, Zea mays
  Clone ID: LIB3279-229-Q6-N6-G10
gaatcaaagcactgaatcacattcataacagccaaactgatttgcctagaacatcagtacacgattgcaggacaagaagcgatagattccatcccctagttcagacactacagaaacaggaagacagagcagcaatcaggccctctcgcccctgatgcggcgcgcgagctggatgtccttaggcatgatggggaccctcttggcatggatggcgcaaaggttggtgtcctcgaagagacccaccaggtacgcctcggcggcctcctgcagcgcggcgacggcggaggactggaaccggaggtcggtcttgaagtcctgcgcgatctcccgcaccagccgctggaagggcagcttccggatgagcagctccgtgctcttctggtacttgcggatctcgcggagcgcgacggtgccggggcgaaacctgtgcggcttcttcaccccgccggtggccggggccgactttcgcgccgccttggtggccagctgcttccgcggcgccttgccgccggtcgacttcctcgccg

SEQ ID NO: 16272 - DNA, 585 bp, Zea mays
  unsure (1)..(585): unsure at all n locations; Clone ID: LIB3279-229-Q6-N6-G11
tttnntttttntatttttttttttttnttttatacaaacgcgtacacatgcctttattgttgtccacatcaacacaaactcatacacgtcagtacgtactgagtacaccatcattcgatttagttctctatagtgccggccgggctccacacacctaacaccgcctaccaacacgcaggttaaggacgcgacgcttttactttggagagggaaataaaaataataataagctggccaccgatcgagcccgtgtgtccggcggtcgtcgtcgccggcgcggctgatcggccgggggcctcacgcggcggtgacagcgatcttcatgccggcctggcagtggcctgggaagctgcaaatgaagtagttggcgccgcgcttcaacgtgacgcggtcgttcccggtggtgagcgccctcacgcccttgggcgcgctgcacgacctgtaccccgccgcgctcacgggcaccacgttgtgcgccttggcgttgtacctgaacgcgagcacgtcgccggcgcggaaccgcttgcccttgggccagttggcgctgttgaagctccacccgccgcggtcgccgaccgtgtacac

SEQ ID NO: 16273 - DNA, 587 bp, Zea mays
  Clone ID: LIB3279-229-Q6-N6-G12
ggttcagcaccatgattacttgttcgaagaaagctaaaaaaattcttgggtcttatccaaccccagaacgagcacactgcagctattattatggtcatctcaagtttctgacagggtcagtcccatttgccatctacgcaggccggctcacacacagagctcagtctccgcagaatcaaatcaaggagccgcggcgcccttgccgtcgccgttggagtggctgggctcccacagcatggttgtctccgcgatcagcgaggtcaccacgtacgggtccatgttggacgccggcctccggtcctcgaagtagcctttgccttccttctcggtgtcgcggcccacccgcaccgacgccccgcggttcgcgacgccccatacgaaggtgttgatgtcggcggtctcgtggcggccggtgaggcggcgctcgttgccgtccccgtacgcggcgatgtgctcccggtgccggaggcccatcttgccgatcgccttcttgatcacctcgtacccgccgtcactcctcatcgacttggtgctgtagttggtgtgtgcaccatcgccattccagtcccccggaattggcttggggt

SEQ ID NO: 16274 - DNA, 594 bp, Zea mays
  Clone ID: LIB3279-229-Q6-N6-G2
aagaacatccaacagtatagtagggtaataagcgttgaacagtaacatcattacacatcaaacaaaaaaaaattatagtgccggtagaagacatctaacagattgcaactgcgattctgtcctgagtttccatgatacatccggagctcctagtcagttcgcagttgatattcaaggtaggcctcaagccttgctcgcaatgttgctggacagccagtccaggccctcatacagaccctcgccagttgtggcacaagtgctctggatgtaccagtgtcgctggcgcagggagtgtaatccaagcttgtcagtaatctcagcagcattcatggcattgggaagatcttgcttgttggcaaaaacaagcagcacagcatcacgtagctcatcctcgttcagcatcctgtggagctcatctctggcttcaacaacacggtcacggtcattgctgtccacaacaaaaataagaccctgggtgttctggaagtaatgcctccaaagaggtctgatcttgtcctgacccccgacatcccagacagtgaagctaatgttcttgtactcaacagtttcaacattgaaaccgatggtggggat

SEQ ID NO: 16275 - DNA, 602 bp, Zea mays
  Clone ID: LIB3279-229-Q6-N6-G3
aaacgctctaaaaacaaccaaacgcgctgtcagtttccatttgttccattccatggcagtggttgttaaccttagagccctgttactcatacacaccaacacagcaacactcactaagactacaaggcaacgacattacaccgctattacagacacagttcaaaacttattagactggaaagctgatttcacagtaaaaacttgaaatattatgtatccatcaatccatgtgtctcctgccttcattctgatccagtagccatcaagaactccccttcgcatactaggtcggcgccaacgtaagctttcccttccatctttgcaattccgaatctcttctgcagcttgatcagagtcattctcatgatcaaggtgtctccagcgatcacgggcttccggaacctcactttatcgatccccgcaaaaaagaagttctctcgagatccacccacttcaggctgcaacatcactattcctccgacctgggccattgcctcgaccatgagaacaccaggcattatgggtcgttcagggaaatgccctgggaagaagttatcattaattgtcacattcttgattgcaacagcatattctcctggttt

SEQ ID NO: 16276 - DNA, 607 bp, Zea mays
  Clone ID: LIB3279-229-Q6-N6-G4
ggtgctgggtttatgttacaccccaactcaagagaaaatgtcactgcggttacagtcatgagatccttcttttttttcaagtaagtactcctaagtattttattagtataggaatataaggagtaagttgcccgttgctctctaatacttcatgcatgtgtaccaagacatccatgcaacatgggcttaatttggcggagatggtggcgtcgggcttgggccaggagcaggcgggccaggcacaggcgggccaggcacaggtgggccaggcgcaggtgggccattggtgaagcacttctcgcagcagtccttcaagcacgccgttttctttctgctatagtatagtataatatcgcgtgctgctcctcgattgttttgatggggcgtttgaccgtgcacgtacggtgcggatggctgaggcaggtggcgatggcgcactgcgggtaggtgatggccggcaggtccttgaagcacgcgttgtcatggcagctgttgttcttgcactcgcgggtgacggcggcggagaccttggcggcggccccggagaggaagtccgccacggcagcagcgccgttgtcgtggtcgtggtcgtggtggtggtggcagc

SEQ ID NO: 16277 - DNA, 486 bp, Zea mays
  Clone ID: LIB3279-229-Q6-N6-G5
aaacgaaaatgatgacttctataaaattttaaatcttaaaaaaagctcccaatctaataacttctaatgttttttcaaaaatctaatgagcttgtttttctagacccgcaattccaatggcacgacacacttcggcagcaccaaagatttgcacatggccttcatgggttgaaaagcactgctcatgtccttttctagttcatcggccactttctcctcggcccacatgaaaccttgaatgttctgaacccactcaattaaaggggctaacgacccccccccctgaattagcatagatatcagggaatactactacccccttctcggggagaatgcgggtaaacaatattatctattgcatcgggtagatgtcgtatcagctaatacgacgaccatttaggagcactcgagctttcaccccaacagaagcagccatcatctaggctctaacttctagctaggagtcatataagaacataagctcat

SEQ ID NO: 16278 - DNA, 557 bp, Zea mays
  Clone ID: LIB3279-229-Q6-N6-G6
gggaccatataccaatttctttttattcaacaaccagacatatccattggacacacaacaaaacgggggcacacgtcatccattggccacaacaaaacagcatagcgatagggggggtccatggggcatgtcacaaccaacacatatcaaaaccatacacaagacagatgcgaaccagatcatctgaaggaccggagatgggacacatggcctgaccccgaaaacaagaccacacactgacggaccaaccacctgtgcggggggggcatagggcagcaagattcatatgcacgctagcccagcaaaatgctgctgtcgccgccaggaggctgccgggtaccacggccttcatgatctccggttgttgagggtgaggccttcccgtctgcaaaattgctgctcccactcattcctttcggcctcgcacgggtcggaggctgtttctctgcagacgctgaatccttcttgggcatgggcttgccgttcagatcagtagacaaggtgctggaccctttcttctttgctggtttcactgggctgtcaatgtcggcctctcc

SEQ ID NO: 16279 - DNA, 306 bp, Zea mays
  Clone ID: LIB3279-229-Q6-N6-G7
aaccggggagattttaaattaatggggaaccacaattaaaaggcgatcatacatgaaaacaaaaacaatggggggcaaacaatttttcaagaaccaccatttttccgcaggggggggtttaagttcttaaaaatttttttttccacacccttgattcttttggggccggtaaagacaaacatcttttcaaacttatgggattcccaaattggggcccccacattctaaaccccaacaattttttggtttccaaaaaaaaccacatgcattttttcattggggggatcgaggacatagggggcccgg

SEQ ID NO: 16280 - DNA, 262 bp, Zea mays
  Clone ID: LIB3279-229-Q6-N6-G8
ggaacacagccacagctattccagcacacactagacaacacacgcaccgcaaatcctactacctctactagcgacacttgttgacggggggggcgccctccgagctccgagctctagtggcagaagatgaccttgagctcgcgcggggcggcgcactcgtgggtgagcgaggggctgtcgtgcgcgtaggtgaaggcctgcgggcactctcgcttgaagaactccgcccacgcgtccgcccacgcgtccgcccacgcgtccg

SEQ ID NO: 16281 - DNA, 618 bp, Zea mays
  unsure (1)..(618): unsure at all n locations; Clone ID: LIB3279-229-Q6-N6-G9
aattaatataatataaataagtaccattcaatatatcataaataagcattgtcaaacaacgcatacataagtatactctaaatctaaactaaaatacaacagtttgcactaatgttaagcctaactttatatgaattcaagtctccacacttttgcgaccaccaaatttgaattccattctatgttttcctgtacaacaaataggagaaaactagacatagcaaaaagctccaagcagcacatcgatgacctcgaagctgcccttgtgcttctcccagttcttgatctctcctacacgcccgatgttcctcccgccggtcaccatgaccacgttgccgacgtcaaacttgaagaagtccatgatcttgttggtctccagatcgatcttgatggtgtcgttggccttgatgagcgggtcggggtagcggatggtgtgaccgtcgtaggtgttcaggtaggggatgcctttctggccaaactaaacagacctcaccttgcagagcttaaacttagcatcctcatccctaattgggtgaagacggaggcaacgtttagttcccgtttgtcttaaggatggaaatggcatccatgaacccagcaggntaggtcttgtcagtc

SEQ ID NO: 16282 - DNA, 452 bp, Zea mays
  Clone ID: LIB3279-229-Q6-N6-H1
aatcaaaataaatttttgggttttttttatttgtccccaaggcaaaaggggaagatgtaaaaacaaaaaaaaaaggggggggggggaagagggaaaaaaaaaaaaaaaagggaggcccggggggaaacaaaaggggggggggggggcgcccaaaacctgtggggggggggccaacccccgggggggccgggggaaccccggggggggggccgaccccggggaaaggcccccccccccgggggggggcccccgggaagccccgaaaaaaacggggggcgaaaaaggggggggggggaaaggggggggaaaaccccccccaaacccaaggggggggaaccaaaaaccccagggcggggtcgggggggaaaaaccccggcgaaaaaagagggggaaaaaaaacccggggcaaaaaggcccccgggggggaaagaaaaaaggggccaaaaggggcc

SEQ ID NO: 16283 - DNA, 607 bp, Zea mays
  Clone ID: LIB3279-229-Q6-N6-H10
cattaaaaaccttataccccattacagggcccctctataaggaaaagagtacagaccagcaatgtccaaataaagtctaaatattacaaccacataaagttcatagtagcaaattctatctgcagtagcaactaaacattattgtctaatcaatgtccaaatctgcagcagcaaattcaatctcaagatcctcaagttgatgttacttccgctcttcggctctgttccaatctttaaggcaagtgattgcctccaccgtcttaggtgctagagaagacattcgttcctcaattattctcccaactatgctaaaggttgcttcagaggaaacagttgagacaggaataacaagtatatctctagcaaactgagacaagacaggaaaactatacttctggtccctccaccactcaagtaactttaccttctcaccccttagtgcgcgatcagtacctacaaagttagtggacagatagtgatttaattcagcattaggattccacctttgagatgaggcggcattttctttccccttcgctctcttccataagtgagctgtaagagaggtatctgaaatttctgcaccagactcaatagcatgtgagtc

SEQ ID NO: 16284 - DNA, 562 bp, Zea mays
  Clone ID: LIB3279-229-Q6-N6-H11
ccaatacgacgataaggggtaataacgacgtctggactcttaactacaataataataaaaaagcattcttaaacaagcaaccggggtgccgggctgcacttaagtcaaagggaaagctgcaaagggtccttattttccttaaacaagttactttttaactgctacataacatgtatgaaacatctaaatacggagatccttgattccttgttaccatgcgatcgaatggatgcacaaagccagcactccattttttgttagaaatgtcctcttcgagggatgtaaaatccacttggaggggtaggcgcccggttccctgcgtattcatatgtatttgcagcctcatagccagcatggcttttgtaaccaaagtaggctgatgatggccctctaccataaggatggacatctataggatggatatcataccgggcagttctctgtcgattatatgcatcactgccattatctcgaattgcaggcgaaatgaatccagcatgaggttccagatcagaggcatatgatttaaatcttgaacttccacccaaattactattgccac

SEQ ID NO: 16285 - DNA, 315 bp, Zea mays
  Clone ID: LIB3279-229-Q6-N6-H12
ctctgaaaaaagaagtgtagctgaccaaaagggatgtctactgtctgcacacaacacaagtttgtcaatgatcaaaatctcgacagcatcaacaactttctaggatcattgacacctgcctatccttgagcagggtgtacctactgttcatcatcagctctcatatgcgctcagaaacttcttagcagcatccaaattcagctctttgtaaacaagcttctcatgagtttcttcaaatgccttgcagaagaactctgcttttgttgttccaatctttttctctgcagccatcttcaacttctgcataaataaatc

SEQ ID NO: 16286 - DNA, 521 bp, Zea mays
  Clone ID: LIB3279-229-Q6-N6-H2
gggatcagaatttgttcatttatgaaatcacgcaaaccaactcgtccgtcagaccagatttgaccccaaattggctcaaaccaacaaaacactcactcattagacaacccaacgccacagccaacgaaatcagcaattcagcagcagtaacagagaaatctcaagggtacaaggaatccaggtcgggccggccggagaccctggccggggccttgccggggtcgacgccgagctccgccgccacgcgccggatgaccccgaactccgggggcctggggtccgccggccacgtcaccaccatgctggccgccttgccccggatctcgcactccgcgagcacgggggggccgagcccgtccaccacgctgccgggggggaccagagcctggactggcttgggaggccccacgccttcccgggcgcgcgccgggcgggtttccaacttcccttccacgggctcgtccggggggagggggccccggtacgtcccgctccggaccgcgtccaaaaccagcacctcc

SEQ ID NO: 16287 - DNA, 593 bp, Zea mays
  Clone ID: LIB3279-229-Q6-N6-H3
aaaacaaggggcatattattatacaataagattttcaacacacgcgtcaatcctgggaaacaacacgatgaaaaacagtccacatatatgagactgtaatactagtgtgcacttcagactgcttaagattaacaatcagaagatacgatgcatccaggaacttcagaacgcctttgatatatgaagaaaaaatgcagtgccgccacaccagaacaccacatagaatgtatgtttgatcaatctgagaacctctccgagcgacacatctttttgccgttgagttagactggttcattctatggtccatggcaacagcatcgcaagaaaagctaatgctatccctgcaaattccacccaagttccttgcattgctgttcatccggctgcagtgtgtttggtattgcaccgaacacacaacgcacagcttcaaacccagagattgtattatggaaaaatgccgatgcctcttccatgttcttctgcagttcatctggggagatgcgcatgaaatgctgtgaggagggtggtggttgtcccacaggcacagttggtgcaatatcagcaaccctaataaatctttctgttgctgcctc

SEQ ID NO: 16288 - DNA, 632 bp, Zea mays
  unsure (1)..(632): unsure at all n locations; Clone ID: LIB3279-229-Q6-N6-H4
acgttactcgaaccgttttatttttcgtacgtacaacgtttactcccattcttttttccccctctaaacccaaaattcataccctatattagaagggaaaagggcatgttgagatgggttaagatagtacaattatcaaaaaagaattgtaaggaaaatcgaatgcagccgagcctattaaagtatcttcttgatgactccccatcttaaaccataatcgagtggacagtgagttatcgccgacccatacactcgtattcctctcccaggccccagagccagggcttcaaaaggggtcaatccattcccttcagaaattcctccgggccttggtcctccagcctttctgccgtctccaaaaccatgtccctcagatcatcctggtacttagttaccctgtcctggagctcaggatctcttgcagccagaatcctagctgccagcaaacctgcattttctgcattcccgatagcaacagtcgcaacaggaataccttttggcatttgcacaatagataggagggaatcaaatcctgatagtgttgaagtcttaatgggaactccgattacaggaagaggagtcaatgaagccaccatccctggtaaatgagctgctccgnctgcacctgcaat

SEQ ID NO: 16289 - DNA, 575 bp, Zea mays
  Clone ID: LIB3279-229-Q6-N6-H5
atccaagatgagttaagaatatgaacggtcatttttttcaggcataaatataaatccgttctcttgccatggtatttagcacgcacaagcaacgcttgaataagtcttgcaaattcaacacaggttctacgaaagtggctttggctaaggaacgactgcaatgtcgagaaacgacactaagttctttcagcgcttcccaccaccgccgcccaacttggggcccttggaacccttctggaccgcaccctttgtctgcgtcttctgggacttgctcacctccgccttcttcgctttcttctcatccttggtcttcttgatgcgctccttgatctcacgaagagcagcttctctagcagcatcgcggacctctggcttctcagctctcttcttctggattacttccaaggaagcacccacaattgacctggagtatggcttcttggtggcgcggcgcctcttctttactgcttcagcatggatatccttcttgtgctgcttcctgtacattgctgtccaggtaagctttgcaggtttcaggcggttgtggaagtagcgcttgcatttcgagttggcaa

SEQ ID NO: 16290 - DNA, 544 bp, Zea mays
  Clone ID: LIB3279-229-Q6-N6-H6
attaataatatatacgataataaaaataaatagatatagcaaagttttttacccaacgacgaacaaacaatgtacgtgtgaacattattgttggaaaggtgttatcacaaccgacaacaagcaccttctttccttggaaggcctcccttccctatgatagtcacttgagtgcataacttgcccttaaagctatcgagtccctaagtgccagacataataggctatacattctgtttggtggcaacaatgagccattttggttggtgtggtactcccgtgtagagtagaagactaactcttcactattgtagtcgttgatggtgctggtagtgatgacatccttggtgtgcatgcaccggtgagtcactgttgtactcggcggcaatgacattaagactgaagaatgggcagatgccgaattgaagcttagccccagagataaagttaacctttttcagcagcttcctctgacatctcaaacttttatctaaacaatattgtcactaattgtttttaccattcaacatctcaaactttaatgttg

SEQ ID NO: 16291 - DNA, 432 bp, Zea mays
  Clone ID: LIB3279-229-Q6-N6-H7
aaaaccaaaatcggggggatttctttccacccggggggtacccgggggcccccatggaaccccaaaatttaaatttcgggcccccccaaaaataggggggcggggccaaaattaatcgggctcaaaacaaatggggccgccaaggggtttccgggggggggcggcaaaagggccaggcggggaaaacactggggaaagggggggggaaaacataatggggacccctttgcctaaaaaaaagggggcccccctttgggaaaacccgggggggaattaaaaaaccccagggggggggaagtataaacttcacccctttttgggagctttttcccccccccggtgggtaaaaagcccttaaaaaacccctgggccccaaatgacgggaaattgcccagggcataaaaagggggggcaatataaattagccctccc

SEQ ID NO: 16292 - DNA, 604 bp, Zea mays
  Clone ID: LIB3279-229-Q6-N6-H8
aaacaataacgccaaacttaataacccagtagcaaagcgggggaataaagtcttacaacgtaagttgtaaaccacacaacgacagatagataagaaccgacagaaacataacacgataggagccactcagggcagatcacaggatagcagtggcacacaagcccgacgacgccgcgccagtagagcgtctagtactcgtcaccctcgtcgccgtcctcaccctcgtcaaactcagcaccgacctcctcgtagtccttctcgagcgcagccagatcctcacgagcctcggagaactcgccctcctccataccctcaccgacgtaccagtgcacgaaggcgcgcttggcgtacatgaggtcgaacttgtggtcaatgcgggagaagacctccacaacactggtggagttggagatcatgcacacggcacgctgcaccttggccaggtcaccgccggggacgacgctgggaggctggtagttgattccgcacttgaagccagtcgggcaccagtccacgaactggatggtgcgcttggtcttgattgtggccacagcagcgttcacgtccttgggaaccacatcaccacggtacatgaggcagcatg

SEQ ID NO: 16293 - DNA, 602 bp, Zea mays
  Clone ID: LIB3279-229-Q6-N6-H9
gcatcaaagagtaacaaattgcattacaagttcgatttccaacatccgatgcacacataatttcatcactgcttcatgattcaggtaagcctgctagcctcgcgattcagataaacctactagtctcacgattcagataaacctaccacagctagagatgaactaacaagagttcctgaaactttcttgaccgcaagacttgtgggcacggccagaaaacgtcgcatctgcagaaggggagaacatcgcgaggagcccatcagcctatccgccgaagccgtagagggtgcggccctggcgcttgagcgcgtagacgacgtccatggcggtgacggtcttgcggcgggcgtgctcagtgtaggtgacggcgtcgcggatgacgttctcgaggaagatcttgagcacgccgcgggtctcctcgtagatgagccccgagatgcgcttgacgccgcccctcctcgccagccgccggatcgccggcttggtgatgccctggatgttgtcgcgcagcaccttccggtgacgcttcgcgccgcccttgccgagccccttgccacccttaccgcgcccggacatggcttcttccgctcgggtctgtggtg

SEQ ID NO: 16294 - DNA, 611 bp, Zea mays
  unsure (1)..(611): unsure at all n locations; Clone ID: LIB3279-230-Q6-K6-A1
atcgtaacaggaaggtagattttattgagcagttcaatgaaaagcttctggtcaagcaggaaggagagaacctccaaatccttgatgtaaggaacttccaattgacagaagtgagcagaactgagtttatgactccatccgcctttatttttctacatgagctgcaactgttcttgacattccggaatcgagcagtatcagtttggaactttcgaggtgaactggtcacgtcatttgaagatcacctgttgtggcaccccgactgcaacacaaacaacatatacatcacaagcgatcaagatcttattatctcatactgcaaggctgactcaactgattcgtcttcagaagaaaatgctggctctataaacataagcagcatactgtccgggaaatgcctggcaaaaataaacactggaaactccaatgcttgcaaggaaagaaagaaggtgtggaagttccggaacacagtctcggaggcccttgaggacatcacggctctgtactacgacgaggatcgcgacgagatctacactggcaaccggcacggccttgtccatgtgtggtcgagctgaaagctgaaactgcggggcggctntcaaccgtagcac

SEQ ID NO: 16295 - DNA, 651 bp, Zea mays
  Clone ID: LIB3279-230-Q6-K6-A10
atcgtaacaagaaggtagattttattgagcagtgcaatgaaaagcttctggtcaagcaggaaggagagaacctccaaatccttgatgtaaggaacttccaattgacagaagtgagcagaactgagtttatgactccatccgcctttatttttctacatgagctgcaactgttcttgacattccggaatcgagcagtatcagtttggaactttcgaggtgaactggtcacgtcatttgaagatcacctgttgtggcaccccgactgcaacacaaacaacatatacatcacaagcgatcaagatcttattatctcatactgcaaggctgactcaactgattcgtcttcagaagaaaatgctggctctataaacataagcagcatactgtccgggaaatgcctggcaaaaataaacactggaaactccaatgcttgcaaggaaagaaagaaggtgtggaagttccggaacacagtctcggaggcccttgaggacatcacggctctgtactacgacgaggatcgcgacgagatctacactggcaaccggcacggccttgtccatgtgtggtcgagctgaaagctgaaactgcggggcggctttcaaccgtagcacggtgatctggtcttcacctgtgcgcgtattaacagctact

SEQ ID NO: 16296 - DNA, 669 bp, Zea mays
  Clone ID: LIB3279-230-Q6-K6-A11
ctgtgacctcagaaaatgacgagaatgcgggaggcttctcgacggaggtgggagacctcggcggagatctgtcaccgtcgacctgtggctgcaacatcgttcggggtccgggaaggggcacaaagcatagctagagttcgtggatctccccggagtctacacatgtggaggctgactgggtctcgtgggattgctcaccatcgaatgaaggagggtgtcgagccggcatttcagctagctgactttcatcactgcctcgatatgatcactgatgtaatacatgctcacgttcggcacccaaatgcccgtagaccgtggtcaacgtaccccatctacaccatgatcagagataacatgcaaaacaatatttctttccctttcattgagacaataagctaaacaaaattgccttcacttcgaactgatctgttttttcaaatggtgacttccatgtgttcgattgtttgaggttagggacgacgtgaaccttccaagctatcagagtgaaaacatcaatgacaagacattcgacgagaagagtcatgtcttggacccatacaagatgctttatgagtacgctcaatccactgtcacgctcaacctactctacgccttctccaccggcggctacgccaacattcaacgcgtcacgcagtggaaacttgatgt

SEQ ID NO: 16297 - DNA, 457 bp, Zea mays
  Clone ID: LIB3279-230-Q6-K6-A2
caaggttctttcctactagctcgtccttagttcttttgagtcctttggttgttcgatgccttctactgattcatgtctcattcggttatgtgtgtcatcactcgtcatggcgtcggtgaagcggtttcgagtgacagggaaggacaagatcgtgcggcggtgcgccgggaagcaacacttgctcgccaagaagaacaccaagggcaagaagagactctccaagatggtctatcgttggaaatgaagggacatgtcatttttctgtccaacgagaatagcacttgtcttctgctaatattgccgctggacaaacgaactctgtgcttttgtgtgcaagcaatactcgctaatagtctgttcggatttctaatgaaccatgtgtgtatgctgcttttggatcagttatattttgaactagcaacgataatgttttggcaggcataaatcacagacgctt

SEQ ID NO: 16298 - DNA, 599 bp, Zea mays
  Clone ID: LIB3279-230-Q6-K6-A3
gctcgcccgacgcgcatcaactcccgccgccgccccttcctctacgtcgctcgcctcgcgcctgcgccaccacctctgccatggccccgaagaaggataaggccccgccgccgtcgtccaagccggccaagtccggaggcgggaagcagaagaagaagaagtggagcaagggtaagcaaaaggagaaggtcaacaacgctgtgctcttcgaccaggccacctatgacaagttgctctccgaggtgcccaagtacaagcagatcaccccatccgtcctctccgagcgtctcaggattaatggatcattggcacggagggcaatcaaggatctgatggcaaggggactcataaggatgatctctgttcattccagccagcagatatacaccagggcaaccaacacatgagggctgttttgcatcttgtcggcgggtctctagacggcttaatgttgctattatttcatgtttatttcgatcatggctcagccagccttactgttgtgtcgaatgttggaatgtttttagattactggactgtttaagctcatgttgctatccaaatattcatcttgaggaataccaatctgtctctgctct

SEQ ID NO: 16299 - DNA, 197 bp, Zea mays
  Clone ID: LIB3279-230-Q6-K6-A4
cccgaggcataatgcctctgttttgctgtggcttgtgatgcctactacctgctcttagacatggtttaagcatttgtgcttctgttgtgtgagacttgaatattcgacgattatgtggtctaattttaaaagagtgggtttttttttttttttttttttttttttttttttttttggggggacagctataaaggggc

SEQ ID NO: 16300 - DNA, 584 bp, Zea mays
  unsure (1)..(584): unsure at all n locations; Clone ID: LIB3279-230-Q6-K6-A6
gttgaaactgtgttccatgaatttgggcacgcccttcagcacatgcttactaaacaagatgaaggctttgttgctggcattcgtggagttgaatgggatgctgtagagttaccctcccagttcatggagaactggtgctatcacaagaatactcttttgagcattgcaaaacattatgaaaccggtgaaactcttccagaggaaatttatgcgaagcttgtagctgcaaagaatttccgtgctggcaccttgagcctgcgtcagatacgatttgccagtgtagatatggagcttcatacaagttatgaccccaatggctcagtgtccatatatgatgtggaccaaagagttgcagaacggacacaagttcttgctcctctgccggaggacagattcctgtgcagctttagccatatttttgcaggtggctatgctgctggatactacagttacaagtgggctgaagtactgtcagctgatgcattctcagctnttgaagacgctggtttggatgatgagaaggcaatcgaggaaactggcagacgattcagagacactgttcttgcgcttggaggtggaaagtc

SEQ ID NO: 16301 - DNA, 531 bp, Zea mays
  Clone ID: LIB3279-230-Q6-K6-A7
gttgctccgcgccgctctcctgtcagtagccgctgccgccgacgctgcaagtgtgggtctgtcgccgtggccatgttcgcctggatcctccgcggctgccgcgacgagtgctccgcctccgaccagctcaagcaggctcacgatgtcttcaaggcgaaagaggtggtcctgcaaaagaagatctctcaagaggtggaacgggccaaggagttcacaaagtcgggaaacaagcaggcagcaatgcagtgcctgaagaggaagaggtactacgagagtcaaatgaaccaagttggaagcgttcagctgcgcattaacaccaaggagagaatgatcgctgatcacacgggcaacaaataacacaaagtgagaccgcatctctggaaccgtgtatcgaacacagctttgttctgttcagatatgaaatcttgtgagaatgagatgtcaaccattggtgtgttcttcgccaaacagcatatcacacttaacattagtgtgcctttaacataagcataagatattacattttggacc

SEQ ID NO: 16302 - DNA, 185 bp, Zea mays
  Clone ID: LIB3279-230-Q6-K6-A8
gggactctttggcccagctaccacgcaattgaaattgtttaaaagagacccatcaatctgcagaggtaggctcttgccaagcagactggtcggaagtgcacaggagggaaggctcccacgaagcacggagcctccaaagctgcccgtaagtgtgcccaacaccactttttttttctagaaggggg

SEQ ID NO: 16303 - DNA, 645 bp, Zea mays
  unsure (1)..(645): unsure at all n locations; Clone ID: LIB3279-230-Q6-K6-A9
catatatcaaacacgaggagttatggagttaatgttgtagttgcaatcaacaaatttgcatcagatactgaggcagaaatgaaggcagtgcacagtgcagctatggctgctggtgcttttgacgctgttgtctgcacacaccatgcccatggtggtaaaggagcggttgagcttggacttgctgttcaacgagcatgcgaaagccaggcagaacctctgaagtttttgtatcccttggaatctagcataaaggagaagattgagtcaattgctaagttctatggtgctagtggcgttgaatattccgagcaggctgagaagcagattgagatgtacaccaagcaagggttctccagcctccccatttgcatggcgaagacccagtactcattctcacatgtcccgtccatgaagggcgccccgaccggctttgttctgccgataagagacgtgagggccagcatcggcgctgggttcatctacccgctcgtgggcaccatgagcacgatgcctggccttcccaccagaccctgcttctaccagatcgacgtcgacactgccaccgggaaggtcatggggctgtcatgaattgaagtccctgatggtatcattcagagaacgtaaattcggngcattcctggatcg

SEQ ID NO: 16304 - DNA, 637 bp, Zea mays
  Clone ID: LIB3279-230-Q6-K6-B1
gcgcttccccacccaaaaggcaaaccaaccaccagtcccaccaccctccgcctccgcctgcgccacagctgccgattcgaaagccctcgtcctgacccctcgcaaaaccctagctccaaccaccatgaagggcaaggccaacgcctccaagaaggatgagggcaggctccgggccggcggcggcggcgccggaaagcgcaagaaggccgccgcgagcggcaagcccaagcgccctccctccgccttcttcgtcttcatgtctgaattcaggcaggagtaccaggcgcagcaccctagcaacaagagcgttgcggccgtgagcaaggcagcaggggaaaagtggcgctctatgtcagagcaagagaagcaaccctatgtggaccaagctgggcagaagaagcaggactatgagaagactaaggcaaatattgagaaggagagcacaagctcaaagaaggctaagactgatgacgacgatggctcgaagtccgaggtcgatgatgaggatggcggtagtgacgaggaaaacgacgacgacgagtaaatagtatctccgctgtcgtgaggtagcaaatcgattgttaggtccccaattagctcactggtttgctatctttaatgttaaggttgttggaac

SEQ ID NO: 16305 - DNA, 497 bp, Zea mays
  Clone ID: LIB3279-230-Q6-K6-B10
atcgacaggaccacattttaatccaaacaatctgacacacggtgcaccagaagacgaagtccgtcatgcgggtgacctgggaaacattgttgcaaatgctgagggcatagccgaggcaaccattgttgatacccagattcctttgactggcccaaattcagttgttgggagagcatttgtggttcatgagcttgaagatgatttggggaaagggggccatgagctcagcctctctactggaaatgctggtggaagactggcatgtggtgttgttggcctgactccattgtaggttgctcgccgggtgcccgggttgcagttgcagctacgctgttacatccttgccttggtggacttttgtcttcaatcgtgttattgggacagtcagacagtgaccttttttgtattacttggattcattccatgcatgtggtatggtgcgtaatagcctttgcaggtcgactgtataaaaagcaatatttagttgaggaaataag

SEQ ID NO: 16306 - DNA, 607 bp, Zea mays
  Clone ID: LIB3279-230-Q6-K6-B11
ggcgctgggccacggtggccagcacaggaccgggtcgtccaccgacggcggcatggcggcctcctcgtcgtgcacccccaccataacgttcgcgttccagcagccgtcccctgcccctactgcgacggcgacgagctccctcgccctcgtccacccctaccaccatggcgtgctaggttacggctccacctgccttctactggaccaccatcacccaaccaccgtcacctcctaggactctccctcgcacgcaggtccatccagcgtccacccggcctgcacccttcaccaccactttcatggccatgcaaaactgagcgccgcacgtttacctgtactctaccacgagggcgtggactgctcctggtactcatccatagacaacggaagcggtctgctaagaacagccggaaccggatcacgagcatcgccaacaagcatgccaaggcggcagaccgtctagggggaagggagcggtggtgagccaggggtcagcagcagcgctggcggtggacaccatgcagatgaacaaagccggccgtggaagaggatgcaaggcgcatcggaaggtgcacgagccgcggatctgcttcaagacgatgagcga

SEQ ID NO: 16307 - DNA, 647 bp, Zea mays
  Clone ID: LIB3279-230-Q6-K6-B12
agagaagaaaaaaaagcaggtatgtttcaccgccatgtggccccaggtcttggatcacaatgttggaaggtccaagtaatcaatgttggaaggtccaagtaacaatcgctggacagtttgattttgtcctctcggtcttggatcacaatgcgtttgcaaggatccaacaggggcacaacttgtccacaaaggcacagtacaacagaggatccggaaatttgatctactagctatgctccatgccattgtacataaactaccgacacgtaaaacagaaatcatcaaccaatgcaaaagtctggtcagcttctctgcgatctccactctccactagcgaatatggtgtgcgttcactatcagtagccctggtactcaaaataccaccatgccagcaggatgcctcacagatagcacaggcactgctctcgaggtcccacaccctccctccgtctttactccttagatgcactggctgcagggcctttctttccgccatacctctgctttcctatgctgaatgggacatacttgtacttgatcatatgcacaatttgtcgcttcattgtcaggacaaaaagcacaatccaataacagagaagtattggccaaaagacaggaacgtcgaatacagagaagaaggtcatgac

SEQ ID NO: 16308 - DNA, 650 bp, Zea mays
  unsure (1)..(650): unsure at all n locations; Clone ID: LIB3279-230-Q6-K6-B2
atgtcaagcaacaaagcgacttcgtctctttggtatacacgcgcgagctcgagcggagcagctgcctcacttatgactacgtcggggatgatcncggaagacagtctcgtggagaccgatctgaacgccgtttctgcccttgccaccctcgcggcgtcgcgccctcctgctgcagctggagtctctcaccgtgatgccctccaggcttgtgcccatcacgcccgcctctggctcaaccgtgcggatgaacccatccaccctgactccaccatcacatatgctggggtgagggcaaagctggatagaatcatggcatcgggctactacacagctcagctagaaatgaggacaccaatggatctggctgctgcagtggcaaactttggagccggaggtgtgcaggtgcaagagagcatggttgtgtcgcctcaggcactggaagcagtcgaggggagccaggatgttgaagaacacaaggacgagaaggaagattctcaggctacagaaatctacagtgaccatcaggctcctgttgttgacgctgaacatgtggatgatgaaggcctggtgaacccagctcatgaagttccttcagctgaggcagagcaggagacatttgacgattattgtggacgatcaggaacaaaaag

SEQ ID NO: 16309 - DNA, 577 bp, Zea mays
  unsure (1)..(577): unsure at all n locations; Clone ID: LIB3279-230-Q6-K6-B3
cgggttcttgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggnggcggcggctacgggggtggcggcggcggctacggnggtggtggcggcggctacggcgggggcaaccggggcggcggctaccggaactccgacgggaactggaggaacctgaacggggggcccgcgcggccaagttatnctgttcgctaccggggtgnnaccct

SEQ ID NO: 16310 - DNA, 620 bp, Zea mays
  unsure (1)..(620): unsure at all n locations; Clone ID: LIB3279-230-Q6-K6-B4
cacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgggaagggtcttcgcgaggctgccaaggccattgagaagcatgctgctcagctttgcgttcttgctgaggactgtgaccagccagattatgtcaagctggtgaaggcgctctgtgctgaacccaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaacacgtttcagtaatactctacatttggatctgggcttaatattatgcnttgcgtcttgggcttgctaggagattaggacaatttactacaagagcccatgaggatatgagcaatttggaattct

SEQ ID NO: 16311 - DNA, 179 bp, Zea mays
  Clone ID: LIB3279-230-Q6-K6-B5
gcgagcgaaaggatgattttaggactgtcttctcatggtggctggacactagacagtcagtgtctctgttactttgttgccctagccatacaatcgttagctccgtgcacaatctacattgagcttagtaacactgtttttttggctatattaaattatggatatgttccgttttgcac

SEQ ID NO: 16312 - DNA, 628 bp, Zea mays
  Clone ID: LIB3279-230-Q6-K6-B6
cccacgcgtccgcggacgcgtggggatggctggcctcagggcgatcggctacagcttcgattacgatgagtaccacgccttcgtccacggaaggctgccgtacgacaacatcaagcccgaccctgttctcaagcacattctcaagaacctgcccatccgcaaactcatattcaccaacggcgacaaggtccacgccgtgagagccctggagaggctgggcctggaggactgcttcgaggggatcatctgcttcgagaccctgaacccgccgtgcccgccgcagggagaccgggagcccgagatcttcgacatcgccggccacttcgcccgctccggcgccgccgccgagcttcccaagacccccgtcctgtgcaagcccaacgtcgacgccatggaggaggcgctcaggatcgccaacgtcaacccgcacaaggcgattttcttcgacgacagcgtacgcaacatccaggccgggaagcagatcggccttcacacagtgctggtgggcaagtcgcagcgggtgaaaggcgcggaccacgcgctggagagcatccacaacgtcagggaggcgctgccggggctgtgggaggaggccgagaaggcggaggacgtgctctacgccgagcgc

SEQ ID NO: 16313 - DNA, 623 bp, Zea mays
  Clone ID: LIB3279-230-Q6-K6-B7
gccggaaggagaaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttcgcaattcgcatccctggctccgtggacttgcatccgcacatcaggatggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaaggagcctttccctcttaccagtaacgatctaattgagaaggctcttggagatcacggcatcatatgcttgga

SEQ ID NO: 16314 - DNA, 593 bp, Zea mays
  Clone ID: LIB3279-230-Q6-K6-B8
cccacgcgtccggcaaagcgccggaaaccaaaccaccgccgcctcggctagctaacacgtacactagcagtgatccccatggcaatgctgccgcgtccaacagcgctcgtcgcagcggtggtggtggcggcggcgctggtgctcgggatggcgtcggcgcaggggccggccgccgcgcccgcgccgggcccggcgcccgggatcagcgacgagtgcttcaacgcggtgctcaacatgtcggactgcctgacgtacgtgacggcgggcagcaaggcgcggcacccggacacggcctgctgcccggagctggccgggctgctcgagtcccaccccgtctgcctctgccagctgctgggcggcggcgccgagtcctacggcgtcagcgtcgactacaagcgcgcgctcgcgctcccggggatctgccgcctcaccgcgccgcccgttagcgcctgcgcagctttcggattccctatccccgagggattggtgcctactgcggcgcccatggcaggcctctctccatcttctatcggcccagatgtgcctgccaacacgccgacgggctcagccaagtcccccgcgggacgcgtcac

SEQ ID NO: 16315 - DNA, 637 bp, Zea mays
  Clone ID: LIB3279-230-Q6-K6-C1
ggagaggaccctttcgtggccgccggtatcctgtcctccacgcaggacacgcacccgccgcagcccccgcagccggcgccgcagcccccgccgccaccggatctctcgccgcgcagtggatctggtggaaggaaggctggtcggaggcccaagcgggttgccgtggccgctacgggcatggtcgcggacgtgattggcaaggagtacacgcgacccgcggctaattctgtagtaagcatgccaaatgcttggaagggtcgggacggggagagcgatggcagcgggtttggtggccgcaaggacagtgttgaagaggcagagcagttcctgtgctccatgctcggggataattccgagcttggcatgggtgttgtcagagacgtgctaggccagtatgggtacgatgttgagaaggctttggatgcattgcttgatatatctggtgtgtcttcagttgaaaacatggaaacaaaccatcaaagtgccagaaggaatgacacatgtcatctagatatgttttctggaaatgggctatcagtggagaatctgactgcagggaatagaagtctacgccagttgacagatgagatatccaacactgggctccagtctgaattaggacacgagtttttatggg

SEQ ID NO: 16316 - DNA, 325 bp, Zea mays
  Clone ID: LIB3279-230-Q6-K6-C10
gtggatcacccttggttgtccttgccagctgtcatgcttttcttatgacataagccaaaagtactggttaaggattgctgatgattgttttccagcatcaaattttgctagcacgtttagtttcccataaggtggggagctagggaagttgcagattgacataagcaagttcatggcgagaaaaccaggttagagtataccttcgattactttagtattaaaaggctcttcacaagtgtcgccaattttattgttgcaacagagcagatcaccttggagcattaagcgtgtttctaattaaagatttaaaccaaattgaagcagg

SEQ ID NO: 16317 - DNA, 611 bp, Zea mays
  Clone ID: LIB3279-230-Q6-K6-C11
gcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcgtgagtccaaaattgttggctttgggtcggagcagttaatgcgagaagtgtattttatcacttctgagtgcaaccttttttttattatttttccgagcttctgcctcttgcatatgttgtagattctcgccgagaagggagtagtagtattacctgatatctatgctaattcaggtggtgtggtcgttagctactttaattgagtgggttcagaacattcaaggtttcatgtgggccgaggagaaagtggacgatgaactagaaaaggacatgagcagtgcttttcaacacatgaaggccatgtgcaaatctttggtgctgccgaagtgtgtcgtgacattggaattgcaggtctagaaaaacaagctcattagatttctgaaaaaacattagaagttattagattggtagcatttttttaagatttaaaattttatagaagtcatcatttttcgtttattgg

SEQ ID NO: 16318 - DNA, 619 bp, Zea mays
  Clone ID: LIB3279-230-Q6-K6-C12
cccacgcgtccgacacgatcaggttggcacctgtgcaatatatatgtggaggcataaaagaatttttgggaattctagggagagtttagaatatatttcctagtattcaattgtgcctagatgttcaactaatcctgcatatttttaggtatgcgaggaaaagtaatggagatgctaactgcgtgttctgatgcattgatggattagtcttttatcctccctgtctgttatatatgcctttattattgtatggagctaataaatcattatccctactgagattgaattttttttgcattgatatcaaataaatcgtccattgaatcattttttctatgttttcagaatgatggacaaggtacaccatgatagtagaatttttttacaccctggttatcttgttttaattcatcatttctgtgctccaattattttggtgaatcttagcatagaacttgaccttctattattttgtatgtttggtttgcatgggataactggcatgggatatatttatgaacattgatatcatttttatgcttactcacatgggataatctgatcttctaactcaagatatttttattttggtaatctgatcttctaactcaagtttgca

SEQ ID NO: 16319 - DNA, 648 bp, Zea mays
  Clone ID: LIB3279-230-Q6-K6-C2
gatggctccgacacctgccaagaagccttctgggatgccatatggaggatctacccacgctggagatgcacagagcgctgcttcacaggtggacaggtcgataacacctctactacaggaggccatggatcctaatttcttctaccagcccagtgcatatgcctctccagcgtattacttccctagtggttatgatggctcagccaatgaatgggactcaaggtatgctggtcatgaaggaatggagatgccccctaccgtgtatggagacatgtaccttggatatggctatgctccatacggcccatatccttcgggttctccagtaccaactgttgggcatgatggccagtcatatggttctcagcaatatcaatacccgtctcaatattatcagcaaccaacaccaacaaacgcaaaacatggtctaaatggtgccagttctcaacctgaaccgccctctgttgccagtcagcaggcacgagttttggtagatgcaacaaaagcaactccaaacgtgagggctaatggtatgacaattgctcacaacagttcgctgccacgtaagcaaacccacctgaatgtatcggtagcaaacagtggtttatatggaagaggacctatgcaaggcagtggaccttctgcagc

SEQ ID NO: 16320 - DNA, 645 bp, Zea mays
  Clone ID: LIB3279-230-Q6-K6-C3
gccctgccttgccttataggttaagcaaatggtaattgctattttgatggaatctgatttaaaattatcagatgacttactcgaggccatcatagataagacatttgaagatgctgatgcggataaggatggaaaaataaataaagaggagtggaaggaatttgcgttacgccaccctaacctgttaaagaatatgacactgccttatctgagggacatcacaaccgtcttccctagtttcgtcttcaacacggcggtggaagattagtcgctccaattgaaggcaataaagcagtactggggattgcttgaggtgcacaaggttcctgaaacctgacggctgttggtcgccttcaaccactgagaatccgatgtgttctgagcatcaaggcagccgccacctgaccatcactcctgctataaattataatataaattataaggctcatccggggtggcagatcggcagcgggaacttacctgatataatttcttgctgccgtttttgcgcagcaatggattgagagttggtagctgtagatacatctagcttccattctatacgtggggatccaggaactgtaaatacgttctattggaattgtgtcggaaagttcctagtacgccagccagatctaggataag

SEQ ID NO: 16321 - DNA, 578 bp, Zea mays
  Clone ID: LIB3279-230-Q6-K6-C4
atggcaaccatgtccctccgctccctcgccatggccatggccgataccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgacatggaagctggggagtttgaggaggtgctagcctcaggcggcgagggtgaggggcagtacgctgcggtggagccgccagaggaggccaaggtctacgttgggaaccttccctacgacgtcgacagcgagggactcgcgcagatcttcgaccaggccggcgtcgtcgaggtcgccgaggttatctacaacagagaaactggccagagccgtgggtttggctttgttaccatgagcactgttgaggaagctgacaaagccattgagatgttcaaccgctatgatattagcgggaggcttctgaatgtaaacagggcatcttctaggggcactcgcatggaaag

SEQ ID NO: 16322 - DNA, 626 bp, Zea mays
  Clone ID: LIB3279-230-Q6-K6-C5
aagaatcagaagaaagagatccgagcctagggttcggtctgcctcccaaagccgccgctacgctttggctgcatcactcgctcctcttcggagcctccctttcgccggcggcgtaggaagagatggcagagcgtttgacccgtatcgccatcgtcagcgaggacaagtgcaagcccaagaagtgccgccaggagtgcaagaagagctgccccgtcgtcaagactgggaagctttgcattgaagtaaccttcggcatcaaaactagctttcatttctgaggagctgtgcatcggttgtggtatctgtgtaaagaaatgtccatttgatgccattgaaatcatcaaccttccaaaagacttggaaaaggataccactcaccgatatgggcctaataccttcaagttgcacaggttgcctgtcccaaggcctggtcaggttttgggccttgttggaacaaacgggattggaaagtcgacagctttaaagtgttggctggcaagctgaaacctaacttggggcgcttcaaaaacccacctgattggcaggaaattcttacatactttcgtgggtctgaacttcagaactacttcacacgcatattggaagaatacctgaaggcaatcatc

SEQ ID NO: 16323 - DNA, 651 bp, Zea mays
  Clone ID: LIB3279-230-Q6-K6-C6
atggattcataattaagaagccacagaaaatccactcaaggtcccgggcaaggagggcccatgaggccaagcagaaggggaggcactcgggttacggtaagcgcaggggtaccagggaggctaggctccccaccaaaatcctttggatgcgcaggatgcgtgtcctcaggcgtctgctgcgcaagtaccgtgaagcaaagaaaatcgacaagcacatgtaccatgatatgtacatgaaagtaaaaggaaatatgtttaaaaataagagggtactcatggagagcatccacaagtcaaaggccgagaaggccagagagaagactctctcggatcagtttgaggccaagcgggccaagagcaaggcttcccgtgagagaaagatcgcaaggagggaggagagattggctcagggcccaagggaacctgcggcagcaccagtatcagctactgctccggctgcagctgcaccaaagaaggcgaagaagtgaaaagggtgatcttctagttctaggacctaattttggagcgccccaactcttttgctgttacatatccaagctgtcagatatctgtaataacatcttagacttgtttgtcccaagtttatttggaacgaattttcacagaatctgcttaatgcttcggtggaac

SEQ ID NO: 16324 - DNA, 317 bp, Zea mays
  Clone ID: LIB3279-230-Q6-K6-C7
cgagagagcagcaggcatggaatggaactcactccccgctccctccacaccaccccagcgttgtggcagaggcgcataccgtcgtgttagcttcgtttctgctgtaaaaaaaaaaacccttagtgttttatttagcatgtagccttaactggtcgtgtgttacagtacagaactgatgctgagttacaacaccctgatctgatccctcaactccaatgtaacccttaacagctcattctgtaaggaacctgtcaccctgttacctgttgctgaactaatgaagtagagctagataatgacgttttatcgtagttatt

SEQ ID NO: 16325 - DNA, 656 bp, Zea mays
  Clone ID: LIB3279-230-Q6-K6-C8
gcgacttcgctcagcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtctttgtgaagaacaccttgccaccaactgcctctttgatgtctgcaatctacgaagagaacaaggacgaggatggcttcctttacatgacctacagtggtgaaaacaccttcggctctgcctagagcaatcgcccctgccactgtaaataaacgagcatgatggggctgctgctattgtaaacctgtgtatatacctcagtctctagtatgctgctgccggattgcttcaatggcttcaatgacacccttagctttcaactgtttggatttctcctgtgacattgaattccttcggtatcgaaacatttgatcatttcac

SEQ ID NO: 16326 - DNA, 665 bp, Zea mays
  Clone ID: LIB3279-230-Q6-K6-C9
gttctagatcgctcgcgatctagaacgcgagcggccgctcgcgatctagaactgctgactcaaggtgaactaacacgtcgagcatgggcgaaagatgtgcaggtgatgaatgaaggcccgggtcacatcccaatgcataaaattcctgaaaacatggagaaacagttggagtggtgtaatgaagcgcctttctatacattgggtcctttgacaactgatattgcacctggttatgatcacatcacttcagccattggtgctgccaacattggagctcttggcactgcacttctttgctatgtaacaccaaaggagcaccttgggttgcccaatcgtgatgatgtcaagactggtgtaatatcctacaaaatttctgctcatgctgctgatttggcgaagggtcatccctatgcacaagcttgggatgatgcacttagcaaggcaaggtttgagtttagatggcttgaccaatttgctttatctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggttatggaacagtagaggaagctgtgatacaaggaat

SEQ ID NO: 16327 - DNA, 614 bp, Zea mays
  Clone ID: LIB3279-230-Q6-K6-D1
ggctacgtgatcccaaaaggctgcaagatcttcgcgtcgttccgagccgtgcaccttagcctggaccactacgagaacgcccggaccttcgacccttggagatggcagcagggcaagagcaagctgcagagcgcggaaggggccagtctgttcacgccgttcggcggcgggccgcggctgtgcccgggctacgagctcgcccgggtggtggtttccgtcttcctccaccacctcgtcacgcgctttagctgggaggaagccgaggaggacaggattgtcttcttccccaccacccggaccctcaagggataccccatcatcctacggcggcgaccggattgcgatgatctctgacctcatggctaggttctccccccttatcttcttcggatcaaggctgaaggctaagcattaggtagagtaaagtggatgtcgtggctagtaggtgcatggtggtttctgccactctcactcactcactcactctgttgtctgtttgttcctgttcctctctgttttcttcttgctctgtaacctggacctggtacgagtcagcagccagcagcaaactcgcgttttgcctgtaaaatctaaaatctgatatgagatgcaga

SEQ ID NO: 16328 - DNA, 636 bp, Zea mays
  Clone ID: LIB3279-230-Q6-K6-D10
caggcagaagttgaggcagattgaaatttctgtcatgcagtaccgtgaatctcttgaggagcagggtctgcgtgacttggatgagattgagaggaaggttgccagccatcgaagacgtctccagtcagaatatggtttatccactccaactgatggtgctaacagcaggcgatcttctgaaagaacatcatcgtcgtcggagcggaaagagaggcatggcgatgcacatgatcatcctaggaaacgtcgccggagccagagtagaagctgcagtcctccaaggaagtctcaggagagggatcgagagcacaatcgcagtagggaccgagatagggtacgcgagaaaagtgcaagccgagggcgagacgaccaccacgacagaagccgagatagagaggacaggagaaaggggaggtgaccgacccgaaaaacctcgtcactatgcaccatttgccctaaccgaagggcccaggagcatcatttgagctgggctacacgcccaccagcatctccatcggtaaacatatattccgcaccaggcaggttaccctggtctgctccatgcttcgtctgcaataggagtttttgaggattaagttgaggttttgtaaagaagactttgtcgttacttttttt

SEQ ID NO: 16329 - DNA, 368 bp, Zea mays
  unsure (1)..(368): unsure at all n locations; Clone ID: LIB3279-230-Q6-K6-D11
ggaagcttctacagatgtcaatttgacccagttgatggaggagaaatgctgcagctggagtgctacagttttctaaaaccgtcagatcaaccgtagcaacacacaattatcatctatcaattgatgccctcctccccgtaccaagaactgtacagtatctttgtgcgccctcgttggccggaggtctaagctaaatatgataatattttctttgtgtatatatatatttcttgttggctctgggtgatgtgtgttctgtctgtggaagggctaaaacacccatctgcagatggacgtaatagaacgtgtcgttattatttatggatggattgaataaaatagcctaacaatgtttctcccccnnaaaa

SEQ ID NO: 16330 - DNA, 562 bp, Zea mays
  unsure (1)..(562): unsure at all n locations; Clone ID: LIB3279-230-Q6-K6-D12
gtctcgcttcgccccttcctctctcggggggggggcctccagatctctaagaccaggagcccggtgaatccacctcgcccgcagcgatgtcggcgagcagcacccccgtagacgcctcgggggagccgatcccgacttcgtcggtgctgatggcggcgtcgaagcacatcgcggtccggtgccggccggagaacgttgccttcctcaactgcaagaagaaggaccctaaccccgagaagtgcctcgagaagggccgccaggtcacacgctgcgtcctcagcctgttgaaagaacttcaccaaaagtgtcccaaggaaatggatgaatatgctggttgcatgtattactacaccaacgaattcgacttctgccgtaaggagcagcaagcttttgaggaagcctgccccatttccgagtagatcttgagagttttacttgcagtggtcttcgcaaataagggaaaaaaggcagaaaaacagcgttcatgatatcccatgtttgttgtcctcatggaatttgtactggtgaatgaatagcacagcctggagctattcaccccana

SEQ ID NO: 16331 - DNA, 326 bp, Zea mays
  Clone ID: LIB3279-230-Q6-K6-D2
caagagagaagactcctgaggcagctgaaaaagctggaagaaggcggcaagggaaacgcgaatgaagaggagcctgcacatgtgcaggaggacaaagggaaggatgttgtgcctgcacagatactggaacaggttggagagagcaaggtcgaggaacagaatcctgttgccacagcctgatcctgtggacctcctgtagcggttcatgtaacaataactctgatctggttttgcacacatgcattacacagtgtaaaggaatgcagccatatatggcgtgtttgaatgcctggatgggctgagacatgccctggccgtgcatcttc

SEQ ID NO: 16332 - DNA, 668 bp, Zea mays
  Clone ID: LIB3279-230-Q6-K6-D3
cccacgcgtccgccccgccgcaccgtcgccttgggtgccaccgccaccgccaccgcgcgcgccgccagggccgcttctctcgccgtcagggcccagccggacaccaccgccgcagccgtctccacctccgcgcctgagccgacgcccgagttcaagcctccgccggggttcaaggcgcccgagcccaagaggttcgaggtcaagtccggccagctgggcagcgtcctcggcgcctcgctcgccatccccctccgcctcggcaccggcgtcttcgtcctcgggtactcgccatctcttgtttctccatcagagataccatcagaccagtatgcactggaatttggagcttggaaggtgaaagaggaatcaaaaataggacagtgcaaacgaccagaaaagcctatcgagatatatgaatttgaaggttgtccattttgtcggaaggtcagagagatggtaacagtcttggacctagatgtattattttacccctgtcctcaaaaaggcccaacattccgacctaaagtcctcgaaatgggtggaaagaaacaattcccttacatgggtggatccaaacacaggggtcgccatgtatgaatccgatgacatcataaaatatctagctgatacatatggcgatggaactgttccaattatgctatcacttg

SEQ ID NO: 16333 - DNA, 399 bp, Zea mays
  Clone ID: LIB3279-230-Q6-K6-D4
cagtagccaaagttcggttccagccgggtgattgccttcattgacatggagatttttatcccacctgatgtcactgcaaaaagtccccaactccgattgctagctgtaaataattgccttccccgaagaccccccattccttccttgattaaaaaaaagcaggagacggtgccattcaagggtagaaaagagcgagcttgtgaaggtcaaatttctgcgcagctatggattcttgtgcttacaatatgttgtttttaatcaggctttcctttctttttcttcttaagtacttctcggtgttgtctgtaagagaggtagctcatgaacgatggctgcctgaattcagtggctgtcgtcaaagttaacagttctagtcgacttaagaattcttgttttatc

SEQ ID NO: 16334 - DNA, 612 bp, Zea mays
  Clone ID: LIB3279-230-Q6-K6-D5
gttaatcttttcttggaaattggtaggttgaacatggctgcaagatacagcaaggacattggtgagatatatcagcaagaacaagatttagagaaggctacagattacctggaaagggcagctgacctttttgacagtgagggacagtcgtctcaatcaaacaccatcaaacagaaagttgcagaaattgctgctcagttggaacagtacccaaaagcaactgagatatttgaagcgatcgctcgtcagtcaatcaacaacaatcttcttaagtatagtgtcagaggaattcttcttaatgctggcatctgtcaactatgtagaggtgatcctattgccatcacaaattcattggagcgataccaggaaattgacccgactttctctgggacacgtgaatacaagcttttagctgatcttgctgcatctatggatgaaggggatgttgccaaattcactgatgcaatcaaagaatttgatagcatgacacgtctggatccttggaaaaccaccctgctgctcagggcgaagaacgagctgaagaaaaaggaggacgatgaggacgaccttacataagtattgtagtaaaaagaaatggtacgatatgttttg

SEQ ID NO: 16335 - DNA, 597 bp, Zea mays
  Clone ID: LIB3279-230-Q6-K6-D6
cggacgcgtggggcctggcctccatgggtttcatgtgcatgcgcttggtgacaccaccaatggctgcatgtcaactaggaccacactacaatcctgcgagcaaggaacatggagcaccagaagatgagaaccgccatgccggtgatcttggaaatgtgacagctggagcagatggtgttgcaaacattaatgttaccgacagccagatcccactgactgggccaaactcaatcattggcagagctgttgttgttcacgctgaccccgatgatcttggaaagggtggacacgagctcagcaagagcaccggaaacgctggcggccgtgttgcttgtgggatcatcggactccagggctgaactgaaacgaatggtcgctggacttcgggggcgcctgggagtgccgtcaccactcaccagcaggctagaataacatcccgagacatcgtgaaataataataataagagcgcctgatatgtgatcagtggtgtactcgccattaagcacctgtggcaaccgatgagctgaactgtgttggactgttggataatgctggttcgcctgagcatgtgttacaagtctggtcggtttgatggc

SEQ ID NO: 16336 - DNA, 656 bp, Zea mays
  Clone ID: LIB3279-230-Q6-K6-D7
ggaccacacagcttgcacagtagaagatgataggcgatgaactggattccgatgtggttgtacgctacttcagaggcaagagcatcctgatcactggatcaacgggtttcctggggaaagtgctcgtggagaagatactgagggttcagccggacgtgaagaagctcttcctcctcgttcgagccgccgatgtcgaggctgccaagcagagggtcgagaccgaggtgacaggaaaggagatctttcaggttctgaaagaaaagcacggtgacgggttcgaaggtttcgtccaagaaaaaatctgccctctgccaggagacgtcatgcacgagaacttgggcctaggcgctgccaaactgagacaagtgtgcaaggaaatagacatcgttgtaaacggagctgcaactacgaatttctacgaaagatacgatgtggctttcgacacaaatgtcatgggagccaagcacatatgcgagttcgccaagaggtgcagcaaactcaagatgctgctacatgtttcaacagcttatgtagctggtgaacaggaaggggtagtgctggagaagccattccgtttgggcgaaaccctgagggaaggcacacacctggacatcgagtccgaactaaacctgataaaagagacgaggagagaactg

SEQ ID NO: 16337 - DNA, 667 bp, Zea mays
  unsure (1)..(667): unsure at all n locations; Clone ID: LIB3279-230-Q6-K6-D8
cccacgcgtccgcacggacgacggttgggttggcagcaggcacttgcgcttccccacgccgccgcacgccaagaaactaaaagggggcaaccgacgggctcgttcacctatatttgttaagtttcaggcagagagaaagatagaggagcaaacagcaactccagaagatgagtctccctcgccgccgccaccttgtcctgctcgcctgcctcctggtcttcctcgtcttcgccgcgtccgcgtcgacgagttccgccgaggtggccccgagcgtggcggtggacttcgtgcggcggtcgtgccggtcgacggagtacccgcgcgtgtgcgagagcacgctggtcccctgcgcggctggcgtggggcgcagcccgcgcctgctggcgcgagcggcgctggtggttggcgccgaccgcgcgcgcaactgctcctcctacatccgcggcggcggcggcggcgcgatgaaggactgcgcggagctggcgcgcgacgcggaggagcggctgcggcagtccgcggcagagatggagcggatgggccgtgccggcacaccgcgcttcgcttggtccctcagcaacgtccagacctgggccagcgccgngctcaccgacacctncacctgcctcgactccctcgcccagcagtcccgcggtggcaaggacagcga

SEQ ID NO: 16338 - DNA, 658 bp, Zea mays
  Clone ID: LIB3279-230-Q6-K6-D9
cgtgaagtggctgagacgtaccctgaaattcaatacgaggaggtcattattgacaattgttgtatgacgcttgtgaagaatcctggtctttttgatgtattagtgatgccaaacctctatggtgacattattagcgatctatgtgctggtttgattgggggcttgggcctaacacccagttgcaatattggtgaaggtggcatttgtctagcagaagctgttcatggttctgctcctgatattgctggcaagaaccttgcgaacccgactgctcttatgctgagtgctgtcatgatgttgcgccacttgcaattcaacgacaaagcagaccggatccacaacgccatcctccagactattgctggggggaagtacaggactgctgatcttggtggaaaggcatcaacatccgagtttacaaatgcagtctgtgatcacatctgagaatcggatgtggttctttccttctgattgttctgtcttcctaatatctttttgtcgcatatggggaggagctttagctttaagagattaactggcagcacctcgaacttctttgggtggttagcacggtttgagaccgtcaaatatttgtgtcgcatatcttgttgtccagaaattctttcaacttcagaacggagtaaataattctgtaatc

SEQ ID NO: 16339 - DNA, 625 bp, Zea mays
  Clone ID: LIB3279-230-Q6-K6-E1
caactgctcaagctatacttgcaccaatatatactcaaggaagagggcaaaggatcttggggtgcattattcaagaagcagcagcggaagattcaggtgaatggcataagcgacgatttgctcagggaagctgcaaggaggatcgatggcttctctggcagggagattgcaaagcttgtggctagcgtgcaagctgctgtttatggccggcctggctgcacattggatccccagttattttcggaggtagttgactacaaagttactgagcatcaccaacgcatcatgcttgcttctgagggtatggcttgatcaataagaaatattttacctggaagccacaggtttcaagctatcaaagatcgggtttggtgatgagcgacaaaactgacaatcacctcccactgacttgtagtcatgttttggatcccgtgggactttttgtaggcggaggttctatttccagaatttttgttccatgtgccttgcctgaagcaaggtctggtcccggatggacatccaaataggctggttgtggtcaactgagtttagtttaactcatttagtaggtttgcgctgtgttttaactttccttagtctctcgtgcccattcttgtagcatctg

SEQ ID NO: 16340 - DNA, 616 bp, Zea mays
  unsure (1)..(616): unsure at all n locations; Clone ID: LIB3279-230-Q6-K6-E10
cggacgcgtgggtggctgcacgccggagccccggcgccagatctcgccaagtgccagggccgccgcaggcccctctttgcctgcgcgaggtctcagaatcccgagagggaaaaagaaaagaaaagatgatgacttcctctgcctgttactacctgtgccgctccctcgtccgggctcctccgctcaagtcggggagtgcagtgcgctgtccaagcgccgccccgccaggagccagcggtgccacctccacctccaagacacaggatccagttgaaaaccagaagctatgtgcctatttggttgagaaggcagtcaacagacttccgccaggagcagagaatatacttgggatctttgatctgcgaggctttcgggttgaaaatggtgatctccagttcctaaagtttttgatggacgtttttttactattactacccgaagcggcttggccaagttctttttgtcgatgctccatttgtttttcaaccaatgtggcaggttgttaaacctctgttgaaatcatatgcctccctggtaagattttgtgataccgagactgtgaggaaggaatacttcaaagaagaaactgtgcctnctgatttccacgattagaaat

SEQ ID NO: 16341 - DNA, 646 bp, Zea mays
  unsure (1)..(646): unsure at all n locations; Clone ID: LIB3279-230-Q6-K6-E11
gaagttcacagctgaagagctccgtgctatcatggacaaaaagaacaacattcgtaacatgtctgtcattgctcatgtggaccatggcaagtctacgcttacagattcccttgtggcagctgctgggattattgcccaggaagttgctggtgatgttcgcatgactgatactcgtgcagatgaagcagagcgtggcattacaatcaaatctactggtatctctctttactatgagatgactgacgagtcactgaagaactacaagggtgagagagatggtaaccaatacttgatcaaccttattgactcgcctggacacgttgatttttcttcggaagtcacagctgctcttcgcatcaccgatggtgctctggttgtggttgactgtattgaaggtgtctgtgtgcaaactgaaactgtgcttcgccaagcccttggtgagaggattaggccagttctcacggtgaacaagatggacaggtgcttccttgagcttcaggttgagggtgaggaagcttatcagactttctcccgtgtcattgagaatgccaatgtcatcatggcaacatatgaagataagctccttggtgatgtccaagtatacccagagaaggggacagntgctttttctgctggtctgcacgga

SEQ ID NO: 16342 - DNA, 615 bp, Zea mays
  unsure (1)..(615): unsure at all n locations; Clone ID: LIB3279-230-Q6-K6-E2
gttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtangctgcagat

SEQ ID NO: 16343 - DNA, 567 bp, Zea mays
  Clone ID: LIB3279-230-Q6-K6-E4
ctactccaaaggaagaaatgaaatcacaaggatcaaagaaagctacaaggatattcgttgctcgaattccgcaatcggtggatgagtcgatgtttcgtagacattttgaagcttttggggaaattcttgatctttacatgccaaaggaacatggttcaaaagggcatcgtggaattgggtttatcacgtttcagagtgcagagtctgtggacaacatcatgcaagagtcacatgagcttgatggtacaacagtagttgttgatcgtgccgctcctaaggatgaagatgtcagataccccccgagtaggccatctcaaggtggctatggggcatataacgcataccatttcagctgctaccaggtatgcaactctgggtgcaccaacgctgtatgaccatcctggatcagcttatggaagaaggtattatggaccctctcaagcagtgggcaagaagatatttgttggtagacttccacaagaagcaaacacagatgatctaaggcagtactttggcagatttggtcgaatcgtagatgcatatattccaaaggaccccaaaagaagc

SEQ ID NO: 16344 - DNA, 571 bp, Zea mays
  Clone ID: LIB3279-230-Q6-K6-E5
gcaacttccatacccccagcgcggcggtgccggagcgagcagagcagccggagggcctgtcggatccgccgccgtcaagatgaatgacgccgatgtatccaagcagatccagcagatggtgcggttcatccgccaggaggccgacgagaaggccaacgagatctccgtctccgccgaggaggaattcaacattgagaagttgcagcttgttgaagctgagaaaaagaagatcaggcaagagtatgaacgcaaagagaagcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattcagggtttgctccgtttgaaagagccagcagtattgctccgttgccgcaaggatgatcaccatcatgtggaatcagtgctgcattcagcaaagcatgagtatgcatcaaaagcagatgtccatgaaccagagata

SEQ ID NO: 16345 - DNA, 666 bp, Zea mays
  Clone ID: LIB3279-230-Q6-K6-E8
gtccatcccggcgacgactggcgacagccgctgccggcctactccaggtccccaggtctacgtcggacccttcgccgcggcgagcaccaccagagatctgtcactgattttgcagtcctcttgtcagatggcgagcacggggcggtcgatgctgctgtcactgctcctcttcgcagtgacgctgtcgctgctggagatgtacagggccaagttcgcctcgtcggagctcatgaccatcgccggtggattcgtctgctccctcctattcctgctactcctcacctttattggaaactatcaagaagctagtggagatagaactgggtggggtgcagttgttgttgcacaacttgtagctcttattgtagccggcactgtccaccgtgtctgtatcacaacatgcttcctgttttccgctggactcctttacgaggttgacaagctctctggtatgatccttgcgaggagtgagtctaaggtgaggcggcactaagcacagaagcagcacagagagatgatacattgatatttttatgtaagaagacatattttgtatgtcaaactggagtgttggttcgcgctggccatcaggccttttctgctagccatataggggctctggattctagatactggtgcgtttgcaccgaggtcacactctgatgc

SEQ ID NO: 16346 - DNA, 638 bp, Zea mays
  Clone ID: LIB3279-230-Q6-K6-F1
cggacgcgtgggcggacgcgtgggttcatgtgcagtgcaaggacgaagccagaatgctaccagaacggcgtgtttggccttcccagggggaagatggatgtggtggagaagatccagcgagggacgaagctgttcttgtatgattttgacctcaagctactgtatggggtgtacaaggcagataccaaggggaggattggatcttgtgcgtcacgcctttgatggcaaattccctgcacaggttaaatttagcgttttcaaggattgtcttcctattcctgagagtagtttcaagcatgccattaaggagaactacagctcaaagggcaggttcacccaagagctcaacactaaacaagttcaaagactattggcactgttcaagcctatcagcctttctaaaccagctccacaacatattgaggatattcgaaaaccaagtgattatgaagaaagaagacagttgcaacatattgaagaaagggctgcacctattaatgtccacgcacatcctcttgaagatcggtacaagatgacacggtcattacatccgccactttttgatgagcctcgacgtgggttggtgcttaatccttatcatatgcaagagcctcaacatgttcctcttaattactatc

SEQ ID NO: 16347 - DNA, 488 bp, Zea mays
  Clone ID: LIB3279-230-Q6-K6-F10
ggcagatccgagaagagccggcgcgatgagctcgccggcgaggtcgaccatctcggccgccgaagacgtcgctgattccatcgacgcgctctaccgcaagtacgaggccctggctgaactcaagtctgaggtgatggaggcgctgcagagggaggtgaggtctctcgacgaagacaactggatgttcgccgcaccgcggtcccgcatcaacctcgtctccaggcctggtgcttacctgcccaagcaaaacgggaagctctcagagttggggcaagcatccaagaaaacaaggaacttctagggtgtacatgcttgtgcttgcaagaagcctggtccatgactccatgatggtagtgaaggctgtagcatcaaggatgatttgttcatgtttcaaatcaatctggttgcttcctgctaattcaatttcagacacatgtaaggatttttcaagtgattgtgacttcaatgtcatggtattgtttatgact

SEQ ID NO: 16348 - DNA, 424 bp, Zea mays
  Clone ID: LIB3279-230-Q6-K6-F12
gctgtttcagtgtgttgcaaagtgccagtctactagtcatgtgtgatccacatgaagaaagataatgagaataccatccggttggcgcgtcgatgtcgagcgcttgtgccatgtatgcaacattctagtggccaatgccgtggacacgagtcacgtcatgacagagatgcactctcggccgggggtcaagacgacgggatgaagaacctcatgagcgagatgataggagtactgattgacaagcccaagagcatgacgctcagtagggacatacctcggtcacccccaacaggttcaatactctgttgttgacgcgtacgtgtcctaaaacattggccggctagcgtgcgcaaaatactgtcggtgcaatgatctcgcaatatactatgatgcaacatcggccccgtttaaatgctctagagct

SEQ ID NO: 16349 - DNA, 559 bp, Zea mays
  Clone ID: LIB3279-230-Q6-K6-F2
ctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactagagagattttt

SEQ ID NO: 16350 - DNA, 661 bp, Zea mays
  Clone ID: LIB3279-230-Q6-K6-F3
cgagacgcgtgggaaaaaaaaatctcatcgactctctcctgagtcctgactcctgacatctccgatcgtcaccgtccccgtccccggcgccgtccctctcgctcttgtcctcggtgccgcacctcctacatctctgtctcaccgctttagcacggccaccacgcccgcctgcgctagatcccatctgaagccggcggccatcatacccgtgagcgctagctgggctgcatctctcacctccacagccagcaagcgagcgtggttagcgccgcagtggtttcaccgaccttagatcgggccgtaagctcgaggactgaccttaatttcttgagcttaaggtctcagtgggtttaatcccgtagtgtatgaggttgacctttaaaggccttacggcccccttgtttcgcacgctacagatatcgagctgttgacatctgcgggtgcatctgcggacagccttgacgaggctgccgacgatgtcgtctctcaactcgctcttcaaccgctccaccttcggcacaaaatgcaaaacatgtttaaatcttgtcatttcaagaatcaagctgctgcgcaacaggagggagttacaactaataaatatgcgcaaagaaatggttcaatatcttcagactggccaggaatcaatcgcgaggattcgagt

SEQ ID NO: 16351 - DNA, 554 bp, Zea mays
  Clone ID: LIB3279-230-Q6-K6-F5
ctcgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtgaggccgacgtcgacggcgacggccagatcaactacgaggagttcgtcaaggttatgatggccaagtgaggagcggtccccgtgaaataagtatctatggattgaagcgaattatcaggcacacaagctggactttgtcat

SEQ ID NO: 16352 - DNA, 612 bp, Zea mays
  Clone ID: LIB3279-230-Q6-K6-F6
cggacgcgtggggtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcaagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcgtctc

SEQ ID NO: 16353 - DNA, 492 bp, Zea mays
  Clone ID: LIB3279-230-Q6-K6-F8
cccacgcgtccgctggcccagcaggtcacagaagaaaattttgagaaggggctgatttatcctcccttctcaaacatcaggaagatctctgcccacattgcagccagcgttgcagcaaaggcatatgaacttggtttggcaagtaggcgccctcggccaaaggacctggtgaaatatgcagagagctgcatgtacagccccatctaccgcaactaccgttgaattcggatcaactccagttatgtgcaaatcagcagcagccttgcgtcaactgcaagatttcctaagaatataactcgtttcagtctttcatactgtaataccctaagctctctagcaatagctgtttcacgtccttttctgcccctacatattccgcagcgtttatctcttgcgatgtcatgtaaatcagctccggttaggcttttggatgctagtcagtcatggtgctgctgccgtccttccggttccggacaaggataaatttggaat

SEQ ID NO: 16354 - DNA, 663 bp, Zea mays
  Clone ID: LIB3279-230-Q6-K6-F9
ataaattgttctcttcaacagatttttcctttctttttttaccattacatcatcactttcctttgtcaaacttctggtagatataatgtgtccatgatgttttttttcttttgaaaactaatgccatgtttttcccctacatttctgaattttcaagtgtcaagtgtgcacagataaaatgtcatgtttccccctacatttctggtttttcaagtaccaagtgtgcatagataaaaacatcagcttgatggttcatttaccaagattgcttattagttgtaattcgtaaacaatccaaaacaccaaaccaaaaccaacaccaaaagctaactaaaccgttacaagcaagagcgaactaaaccaagatagaagtttgctattggattacaaatgtttctggaagctctgctgagccgtttattcaataatcttcagatacattccatctgcaagggaatgcccattatatttacaacttcctgatggtgggctttcaaaaaccaatgcatttatatcccctatgtggggaggtgttcttatctggaactcaccggactgttcacttggttccaagaaaactcatggtacccagaagaaaatgtcatctcaggaacttatggaggcactcgaaatattgttggacaactaaggcagctgtttggt

SEQ ID NO: 16355 - DNA, 422 bp, Zea mays
  Clone ID: LIB3279-230-Q6-K6-G1
cagagctgaagtgcactttcaaccttgacataatttctgtgaagaaaaacccaaatggtccaatgtacacttctcttggtgttatgacaaggggaacgatcattgaggtaaatgtcagtgagcttggtctggtaactcccgctggaaaagttgtttgggggaaatatgctcaagttacaaacaacccggagaacgatggctgtatcaatgctgttttgctagtgtagatccatagtgagattttgttgatggtggtgaatcgtcccatttgtatctgctccgatatgctattttttgaccatgtcatggctaatcccagtagtttgttgtgcaccatgggcataatgagcattctgtattctcgctgtgtgctacaaacatatatggagtaatataaattagcagtatttttttttgagctt

SEQ ID NO: 16356 - DNA, 210 bp, Zea mays
  Clone ID: LIB3279-230-Q6-K6-G10
cctagttggaagttttcttactcaattgaatgaacgagggaacttattgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggggggggggggatttaaaaaatggggagg

SEQ ID NO: 16357 - DNA, 667 bp, Zea mays
  Clone ID: LIB3279-230-Q6-K6-G11
cgccttgtaccgtcttgagtacaagtcctctgaccccaaaaagggtgctgctaagtcaaaactggctagtccactgaatgaaatccggcagcgaatgggcaggctgactgcagacagccctgtggaaaacaagcggactgctaggagcaagccaaaggctaaccagaaccagaaggataccaatgcaaatacccgtccacatgttaacactcccaatcaagttaatgctccaaatgcttatcagacaacgcagcaggtgaaccaaatggcatttctgaatggaaacgttgtttatggacctcaccttccacattctgaaagcgtcgtctatggacctcatcttccacattctgaaaacgttgtctacggacctcatcttccacattctgaaaacgtcgtctatggacctcaccttccacagggatactcagccgaaggaagcagcttcttttggaacccaagtgacgggacttgaagacgcaggcagcatcatgtagctgctcatgcattgcatggcacttatcaagcaaaaacctctaacatcatcgaccaagttgggactgagtagcttggcccttcacatttctaaattctaaatggttggtttctgcacgggggcctggcaggtcggtgtatttgaattttgaaatgcagaggtatacttgca

SEQ ID NO: 16358 - DNA, 630 bp, Zea mays
  Clone ID: LIB3279-230-Q6-K6-G12
cggacgcgtgggttctgccgtctccagcgcgcggggcagccatcgtcaccggagggatctgccgtctcccttgctccacgcgatgaacaccgacatcaccgcctcgactaagccggagtacccggtggtggatcggaacccggccttcaccaaggtggtcggcaacttctctgcgctcgagggcgtgcgcctctccaccatctccgccgtctccgtcaccgttggctacctctccgggatcaagccggggatccggggcccgtcgatggtcacgggcggcctcatcggggtcatgggagggttcatgtacgcctaccagaactccgccgggcgcctaatgggattctttcccaacgacgccgaggttgcgcgctacaagcacaagcttcattgaggatccagctccattccgtctctcttttcgcaaccgtttcgcctgttcctttcctgattccgtgttaacttcagtactttatctgggcactctatggccttggttaaataaaagtggtatgttgttgcacggttatgaggattcgatgatacaattcacctcatctttatgttgtttggtgagaatttcgtcgccgtttgggtgaatttatgaatactgaagtgatttctgctctg

SEQ ID NO: 16359 - DNA, 500 bp, Zea mays
  Clone ID: LIB3279-230-Q6-K6-G2
gaggtgttagctgatgcaagaatgttgagatttgaaaaaaaaatgttggattagggatttaccgctcatggagatgataggaaaacaacctgtcgtttccccatccatccacgagtggcttttgcttgctttggtgggctaccagcagacgcagcaagagcctctctctctctctcgtccctctgtttgcaaacctttttttacttgcaaaagaagcttgccgtgggctccatgaataagggcgtttgctttgttgtcctaagtatttatcaaaggaattgtttgtgtttcgtctgtaccagtgcttgctagtagtaccagtgccccccccccctgtttcgctactagtaatggtgtttattagtgaagtggttagttgcttagcagctgctggttgcaggtttccagtgtcaacagcggcgatataaatttatattatatatatcttgtgtatgcctctcatggctttgtggtacaataatatatggaatttcactact

SEQ ID NO: 16360 - DNA, 649 bp, Zea mays
  Clone ID: LIB3279-230-Q6-K6-G4
gttgatttcaagaaacttgttagtgataactggatcgagccacctagaagagaaaggaagagaaactactctgagtctgattactttaagcaagcgcttcgccaaggtgcaccagcgaagcctagggagccaaggattccaagaatgccgcacttgcatgatttccagtttttcaataaccaaaggctaaatgaattgtacgaaaaggaagtgcggtacctcatgcaagcaaaccagaagaaagataccattgatggtgaagacgaagatcaattggagcctttaacagcagaggagcaggaagagaaggagcagttattagaagagggttttgcatcatggacaaggagagacttcaacacatttattcgtgcatgtgagaaatatggtcgcaatgatattaaaagtatatcctctgaaatggagggtaagacagaagaggaagttcaacgctatgctaaagttttcaaggagagatacaaggagctgactgattatgatagaattataaaaaatattgaaaggggggaagcaagaatatcccgcaaggatgagattatgaaggctattgggaagaagttagaccgctacaagaacccatggttagagttgaaaattcaatatggccaaaataaagggaagttctata

SEQ ID NO: 16361 - DNA, 657 bp, Zea mays
  unsure (1)..(657): unsure at all n locations; Clone ID: LIB3279-230-Q6-K6-G5
gcgccacctagggtttctacggagggggagaaatcaggaaggaggagagcgacgataaagctcgtgggtagctaacggtgtgagctcaagtaccatctccaaagtgtccccagcggctaatgggtagatcatgtccataccgacgtttgcggcatttggccgttgtcaacgtctccaaagtgtcaaagtcgttccctacgtcatttcgtcaaaatcgagcactgtcgtgttcttatccggtcccgaacaaacaaccccgcttctgccggccgttttggaggcgttgcggccatggcggcttcgaagcccatcttgtatagcgcgtggatcagctcctgctccttccgagtccggatcgccctcaacctcaaaggtgtggattatgagtacagggctgtgacaaggaacgatctagattacgaaaagatcaatccaatcaagtatgttccagcattggttgatggggattttgttgtttctgactccctggcaatcatattgtatcttgaagataaatatcctcaacaccctcttttgcctcaagatctcaaaaagaaagctataaatctgcagattgcanatataagtttgttcaagcattcaacctcttcaatgttatgctgtaatttggtctgcttgatggcaccttangctcta

SEQ ID NO: 16362 - DNA, 465 bp, Zea mays
  Clone ID: LIB3279-230-Q6-K6-G6
catttctctctgtttccgttaaatgttgctcctgttcaagaatccggtggattatcaacaagaccaacagaaacatatgaatcaaggacaagcaatactgatggaactggatttaacgatttggaagcgtcggtgttccggaaacttcgagaggcccagaaaaggaaacattttggttaattgttttgttctgatgcatgatttggtactatgtatatgacgtcacacagctgaaaaatatctgaggatcgtgatggtagctgagttacagaaatctgaactacacatttgtttagttcgagtcttgtcgcagataaaattctctgaatcatagcaacgtcagatcgatttttctgtcactgtacaagctgtaccatgtatctatgaatagtttgtaaccacaaattcatgcatgacatggcgctacacatctttttgctggaaattgggaacacaacccctttc

SEQ ID NO: 16363 - DNA, 395 bp, Zea mays
  Clone ID: LIB3279-230-Q6-K6-G7
gctcactgaagacggtgaaagtgacgagcaggttgttttggttagccagagtggcactgcaaacagaatcaaagttaaagatatatccgtccagtctcgacgctcgaggggagtgattctgatgaggctggagcatgccggaaagatccagtcagcatcactgatatccgcagcggcagcagaagtaactgaagattagtcttgcacccaagatgcaagtagtttagtctgaatttaatccctggcgtacgctgcagcatgaaatttgtctgctttcctgtggctagtaagcgtcaggaatcatgtaaaatcctacgccaaggagtagtcggtagctgatcatttggtggatcagaaactaaatactcactctaatcagaaaccaatgttgtcct

SEQ ID NO: 16364 - DNA, 648 bp, Zea mays
  Clone ID: LIB3279-230-Q6-K6-G9
cccacgcgtccgcccagaactccaccgagagaggggaaggactcggggagtaaactcgggtccgtgtgacggcagagagtttccgtcgaggagagagaagcagctgggaagggcactcacggagcttaccgagaaaaaggggtcgaggttcatgcccgtttggttcctcggttgctgcgtgaggcggccggaggagtcgtgaaccgggaatgacgggggtggtggtggtttccagcgcggggtgcaagggtggcggcggggggaagagggccgccggcggcagaggtggcggggaggaggagcggcggcggcgggcggcggttctggagctgctgctcgcggccgtgcggcgctccgtggtggcgtgccgggtggagcgcggggccgccggagccgggtggccggcgagagaggaggacgcggcggtggcgctcgaggagatggagatcggctggcccaccgacgtccgccacgtcgcccacgtcaccttcgaccgcttccacggcttcctcggcctccccgtcgagttcgaggatgagatgccctgccgcgtgcccagcgccagcgccagcgtttttggtgtctcggctgaatcgatgcaatgcacgtacgatggcaagggaaattcagtccccacgatattgctgc

SEQ ID NO: 16365 - DNA, 457 bp, Zea mays
  unsure (1)..(457): unsure at all n locations; Clone ID: LIB3279-230-Q6-K6-H1
cggacgccgtgggcgcctctaccctcctcaaaccctacaccacgccccccggcccccagcccccggccttcgcccaacccgatagcgtagcgccggcgcagaaccggaccctgccgtgcggttgtccaccccgctcggcgccgcccgccgccgccgccgcctttgatgtctcctacctgcgacctcggcttcctctgcccccggtcgcagaagagctcccaagaggtcccccgagccaccgcttccggcgcccagcgattggcttccccaccgcagccgagatgagcagcggcggcgagaagatgttgttgtttgggtcctttacggaggacgagactaagttgttacagggtcagcccctcaaaagtccaactaaaagtgtcagcaaagaatgtgaacggacggagatccagtttggcaccctgaacttgtcagtgctgaatntagagaaatatct

SEQ ID NO: 16366 - DNA, 505 bp, Zea mays
  unsure (1)..(505): unsure at all n locations; Clone ID: LIB3279-230-Q6-K6-H10
ctccctctcctctctcctctccctaccgagtggcgcgagccggcgagccctagcaggcaaaagccatggcgtccatggttcttcgtgccgctgccgccgctcgtcttccctccctccgtcctcgccgcaacggcagcggggtgctcaccggcttgaggatcgggacagggcactacggggggcggctcgcgctttcttcgtccgcggcagcttctcccaaagagttcgaggtcgcttgccttcctgtcgatgatagcagattgggcccgggggaagattatgtgtctgaccttcgcatggcagacgaggaggagttggaccatttctaccgtgttctcgccattaagactgacatgctgtttagagcctaccctgaacacaagccgtttgcagtttctgaagaggacaaggccgtgcaggagaggttgaaggaatttgcgaacgaatgcatcgacctcctggatgatgcgttgcgccgcatccccgcggagaanaggcgcccact

SEQ ID NO: 16367 - DNA, 659 bp, Zea mays
  Clone ID: LIB3279-230-Q6-K6-H11
cccacgcgtccgcgctcatccccaacatggattaggaaattagcaatattaggggaaaggccatcaaagatgcatctgttccggtgattccacaaaatttcaactgactgttttctgaagcattgcaaaattatgttattactatgaagtccagtgaagaaactacttttgtgatgactactcatgtcacttttgaattgttacacgtggttaggggaggaaacctcttggaggttgtagttctgatgggtggtatggtagggtgatgggctttgttgctggcaactcgtgatggtttttccagccttggtgaacattggcagtggctacagcttgggcaggggctggtggcagcgcaaaggagagtgagagggaactttaaggcaaaaacacttttctggttaatccatatggatacatccaaaagatgttatatatatgatccacccttcttaattcaattcaagctttcgccacaaagctctcttattctctaatactgataactttttggcggccccgaattggaggggtatggaggttgcagcatgctagccgtaccctctggttgctgcaacatgtagatgtaggtggtggctactgcctcttgggttcagctgggctgcttgggccatgggcattatgcccaaaacataaat

SEQ ID NO: 16368 - DNA, 655 bp, Zea mays
  Clone ID: LIB3279-230-Q6-K6-H12
gctagttgttgctccaggcgggggagcaagggcgcgtgtagtacaaaatgccgatatccctgttaagcaaaccactagctcttcctcacgtgagcagtcagacgatgatgacatggaaggagatgctgagactactggaaatggaaaccctgttcaacacagattacagagaaggaagggggggggccgagaatcagccaggcgttcaagaagcagaaaggcagcgcacttgaatgaactggaggcacaggtagcacagataagaggtgagaactcttcgctgctaaggcgacttgctgacgttaatcagaagttcaatgaggctgctgttgacaatagggtgcttaaggcagatgttgaaaccttaagagcaaaggtgaagatggcagaggactcagtgaagcgggtaactggcatgaacacattgttccctgccgtgtctgatatgtcgtccctcagcatgccattcaatggctccccatccgactccgcctctgatgccgccgtacccatccaagatgacctgaacagttacttcgccattccaagcgagatcggaggcagcgaccgttacatgccagatatagcttcctcggctcaagaggacaacgatttcgtcaacggggctcaagtcgccggcaagatgggcagcact

SEQ ID NO: 16369 - DNA, 660 bp, Zea mays
  Clone ID: LIB3279-230-Q6-K6-H2
cccacgcgtccgtataaatagtattctatgccaacttctggagtcgtccaagcaccttactacatattatctgaactttgaaatgcatagcttagaagttattattattttttatccttttttccagaaaatatgtgtaatacctgaagttctgtagctgaattactaagtatttaagtaacctaccataacatggagttactgaattgcttagtcagtaactagcatttgtagctcttgttttttaatacagcaatctcaaatacaatttcctttgtagaaatattttagttgagcaatctgctggaaatttaatattttcgattcatccaggatgaagctgttcaaaaggtggtagagtttatggatacatactctttaagccaggaagacttcgatacgattgttgaagtatccaaatttaagggtcatccaagtcctatggatgggattcaacctgctgttaaaagtgccttgacaaaggcatacaaacaaggaagtagttcccgtgttgttcgagcagcagatctaataaacattccaggcatgaaaaagcctttaaagaaacgagtggcggcgatcttggagccggtagaagagagcctacctgaagaaaatggactagcatcagctgaagatgatgaagatggttcttctgat

SEQ ID NO: 16370 - DNA, 405 bp, Zea mays
  Clone ID: LIB3279-230-Q6-K6-H3
gttctctcttattaaatcagcatatagccaacttgtagcatgacagatacatacataggtatacagacgcaaaaaaatgtcacccgttgagccagccgattggagaccaaacaccgcggcaatgcatttacacaatatacgcaaagaataaaggaatgcgcccccacgggaaactagcagcagcgtggcttgtccaggagactactctgaatcatagaagtcgctagggcacggtgtaattacatccgactccagcatctgtaccaccctgtgcattgtcggcctctcctctggcgaggagctaacacattgcttggcaagagagagcagagcatctaaggtctcagtctgcactccttcacagttcaggtcgacaatttccctctcccgggttctagatcgcga

SEQ ID NO: 16371 - DNA, 420 bp, Zea mays
  Clone ID: LIB3279-230-Q6-K6-H4
cggacgcgtgggttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgag

SEQ ID NO: 16372 - DNA, 663 bp, Zea mays
  Clone ID: LIB3279-230-Q6-K6-H5
ctcaagtgctcagtgctcaccgctctgcccctgcctcatcacacgcgcgcacggcgcacagataccttttctctcctctcccgtcccactctcctgggcaatcccggcccggcatggcgagcccgtcctcgtccccctcgcggaaggctctgagcaagatcgcctgcagccgcctgcagaaggagctcgcggagtggcaggtcaacccgcccgcgggcttcaagcacagggtcaccgacgacctccagaggtgggtcatcgatgtagcgggggcagcaggcacgctctacactggcgaaacctacaagttgcaggtggatttccccgagcattatccgatggaggcacctcaggttatatttctgcatccagcaccgatgcatccacacatttacagcaatggacacatctgtttagatatactgtatgactcgtggtccccagcgatgactgtcagttctatctgtatcagcatattatctatgctgtccagctcgccagaaaagcaacgcccagctgataatgatcgctatgtcaagaactgtcgcaatgggaggtctccgaaagagaccaggtggtggttccatgatgacaccgtgtgatcggtgttccgattattgttgtcctgtatgcatttagttgccagactatgggagatggact

SEQ ID NO: 16373 - DNA, 652 bp, Zea mays
  unsure (1)..(652): unsure at all n locations; Clone ID: LIB3279-230-Q6-K6-H6
gccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagagattccatggggtaactttggggctgaatatgttgntgaatctt

SEQ ID NO: 16374 - DNA, 653 bp, Zea mays
  Clone ID: LIB3279-230-Q6-K6-H7
ctggaaccaagattgcggatgcttcgcggctggtaccagcaatgggtttaggatatttaactgcgaccctttcaaggagactttcaggagggatcttaagagcggcggtttcgggatcgtcgagatgttgtttcgttgcaacatccttgcccttgtaggaggcggctccaatgtgcagtacccgccgaacaaggtgatgatctgggatgaccaccagagccgttgcattggagagtttgccttccgctcagatgtccgagccgtaaagttggcgaaggactacatcgtgattgtcctcgagcgcaagatattcgtctacaactttactgatttgaagctgctctaccagattgacaccctgtcaaatcccaagggactttgctgtctctctcataattccaatacttcagtattggcctgccctggggtgcaccagggtcatgttcgcgtggagcatttcgggctgaagatggcgaagacaatctcagctcatgattcacacatctcttgcatgtcactgacaatggatggtctcctactggcaacagctagcaccaagggcactttgatcagaatattcaacacaatggatggcactcgcctacaagaggtacgcagagggcttgacagagcagaatatatagcattgcagt

SEQ ID NO: 16375 - DNA, 478 bp, Zea mays
  unsure (1)..(478): unsure at all n locations; Clone ID: LIB3279-230-Q6-K6-H8
tctcgcttcgcttccattccatcgcgccagtcgccagactcaccagggagagtaggggaaaatatcaattagaaacaacgaggaactagcaaataaagaaggataactcccataagaaaaatcgccaaatacgccattcatcttcttcgcccgggtttcagaacgtgcggcagtttagccaggatggtggcgatcgagaaccagaaccagagccaggccgcggtggcggtggcggcggaggcggtgccggcgccggcgccgcggatccccaaggaggcgcggcgcctgctgcacgagctggcggcggcgtgggcggacgtggccgactgccgcgcgctggaggtcgtgccgctcaagggggccatgaccaacgaggtctaccaggcgcgctgtctcactgcaggccctgccggccaggaggaggagcccanggcggaaagggaggtgaggaaggtgctcgtgcggatttacggcgacg

SEQ ID NO: 16376 - DNA, 654 bp, Zea mays
  Clone ID: LIB3279-230-Q6-K6-H9
cccacgcgtccgcccacgcgtccgcgggcgcgtgggaaaaaagtaaactacaattattaatttataatgcgatttatattgttaattgctcaaaacaatcaataaataacatctctcaagaacttcgaatacaaatatgttcatacaagtttatgcataaatttgacataatttgactatgatgtgtcaaactttatgacttgtagttccactaattttgactatgcataaaagctgatttgcgggcaaccaatttttatccgagaggaaggcttccattcatgatataactttataacaactcaacatttctcatgaattaatggctctcttaaacaatatagtgttagagcatttttttctgtatatatcttttatgcctactgaaccactatgcattgtagttcatgatctaaattatctaaaacaaaacccatactgcatgagttgaaccataattagttactttagttacgataaaaaatgatcagatacttcagggaatgttctaaccaaaaccaacacccaagtatgatcgtctgaattataattactagggaaaggtagattgcaagaactaattttgcctacatgtttaacttaaaacgcatttttgtgccagctgtagggtttggcatactctcatggtgcttt

SEQ ID NO: 16377 - DNA, 482 bp, Zea mays
  Clone ID: LIB3279-230-Q6-N6-A1
caaatcaacgaagggatttcattacttgcaagggccgtccgttacaacagatctggggggcccctgatttcaaaatgatggacagggctcttggcatgctgaaataaaaaaaaactgccacttgaggggcttggggggtccctttttcgggccccccacccccgggccacgggaggcactagtagctgttaatacccccacaggggaaaaccaaatcaccgggctacggttgaaagcccccccgcagtttcagctttcagctcgaccacacatggacaaggccctcccggttgccagtgtaaatctcgtcgcaaccctcgtcgaaatacaaagccgggatgtcctcaagggcccccaaaactgtgttccggaacttccacaccttttttttttccttgcaagcattggagtttccagggtttatttttgccaggcatttcccggccagtatgctgcttatgtttataaagccagcattttct

SEQ ID NO: 16378 - DNA, 457 bp, Zea mays
  Clone ID: LIB3279-230-Q6-N6-A2
aagcgtctgtgatttatgcctgccaaaacattatcgttgctagttcaaaatataactgatccaaaagcagcatacacacatggttcattagaaatccgaacagactattagcgagtattgcttgcacacaaaagcacagagttcgtttgtccagcggcaatattagcagaagacaagtgctattctcgttggacagaaaaatgacatgtcccttcatttccaacgatagaccatcttggagagtctcttcttgcccttggtgttcttcttggcgagcaagtgttgcttcccggcgcaccgccgcacgatcttgtccttccctgtcactcgaaaccgcttcaccgacgccatgacgagtgatgacacacataaccgaatgagacatgaatcagtagaaggcatcgaacaaccaaaggactcaaaagaactaaggacgagctagtaggaaagaaccttg

SEQ ID NO: 16379 - DNA, 615 bp, Zea mays
  Clone ID: LIB3279-230-Q6-N6-A3
agagcagagacagattggtattcctcaagatgaatatttggatagcaacatgagcttaaacagtacagtaatctaaaaacattccaacattcgacacaacagtaaggctggctgagccatgatcgaaataaacatgaaataatagcaacattaagccgtctagagacccgccgacaagatgcaaaacagccctcatgtgttggttgccctggtgtatatctgctggctggaatgaacagagatcatccttatgagtccccttgccatcagatccttgattgccctccgtgccaatgatccattaatcctgagacgctcggagaggacggatggggtgatctgcttgtacttgggcacctcggagagcaacttgtcataggtggcctggtcgaagagcacagcgttgttgaccttctccttttgcttacccttgctccacttcttcttcttctgcttcccgcctccggacttggccggcttggacgacggcggcggggccttatccttcttcggggccatggcagatgtggtggcgcatgcgcgaggcgagcgacgtatatgaaggggcggcggcgggagttgatgcgcgtcgggcgagccgtacgcgtgggtcga

SEQ ID NO: 16380 - DNA, 463 bp, Zea mays
  Clone ID: LIB3279-230-Q6-N6-A4
aaaattaaaccaaaaaaacacaaaaaaaacaaaaaaacacaaaaaaagcacaaaagccaaaaccagggcaaaaagccaaaaaaaaaaaaaaaagccaaacccgaacggagccgcgggcccaccccggacacccgggccgaccccggaaagcgggaccggcccccgcagggggaccaacataacaaaaagggagaaaaaaaagaacaggggggaaccaggggaaaaagggatccccgggcaaaatcgcaaaccagatcaaaactcaaaaaaaaaaagaaaaccgaagcaaaaaaaaaaaaagcgggaaagcccaaaaaaggagcgaacccaaaagaaccgggttgagccaacaaacccgtttcccgacgggaaaaaaggaaaaccccccccctcaaagaaaggggcaacccccagggagaggccgggtgggttttctccccccaggggggacaggcaacaacca

SEQ ID NO: 16381 - DNA, 612 bp, Zea mays
  Clone ID: LIB3279-230-Q6-N6-A6
atgtctatattcaaatagcagacgatgaatctagacacatatacaaaaacacatacattaataatatgtgttgtttgtttgtcttctaacttatttaataatctagaggagggtaaacaaacaagggcgaaatgtctatcttcatcaaataattgaccggatgaaaatggtccctgtttaagcataaataacagagaaatctttggggcactaggcagcaacaggaagcaagccgttttgtctaagaagtggttcaggcgaaggctcccgtcctcggaatgaaacgaacacctcaagcggagactttccacctccaagcgcaagaacagtgtctctgaatcgtctgccagtttcctcgattgccttctcatcatccaaaccagcgtcttcaaaagctgagaatgcatcagctgacagtacttcagcccacttgtaactgtagtatccagcagcatagccacctgcaaaaatatggctaaagctgcacaggaatctgtcctccggcagaggagcaagaacttgtgtccgttctgcaactctttggtccacatcatatatggacactgagccattggggtcataacttgtatgaagctccatatctacactggc

SEQ ID NO: 16382 - DNA, 531 bp, Zea mays
  Clone ID: LIB3279-230-Q6-N6-A7
ggtccaaaatgtaatatcttatgcttatgttaaaggcacactaatgttaagtgtgatatgctgtttggcgaagaacacaccaatggttgacatctcattctcacaagatttcatatctgaacagaacaaagctgtgttcgatacacggttccagagatgcggtctcactttgtgttatttgttgcccgtgtgatcagcgatcattctctccttggtgttaatgcgcagctgaacgcttccaacttggttcatttgactctcgtagtacctcttcctcttcaggcactgcattgctgcctgcttgtttcccgactttgtgaactccttggcccgttccacctcttgagagatcttcttttgcaggaccacctctttcgccttgaagacatcgtgagcctgcttgagctggtcggaggcggagcactcgtcgcggcagccgcggaggatccaggcgaacatggccacggcgacagacccacacttgcagcgtcggcggcagcggctactgacaggagagcggcgcggagcaac

SEQ ID NO: 16383 - DNA, 631 bp, Zea mays
  unsure (1)..(631): unsure at all n locations; Clone ID: LIB3279-230-Q6-N6-A9
tttttnttttttcaggcatgggtctaaaagcacggttcaagcacatttacagtctccggtttacaaaatcaagtaaaaggaagcggcactgaacttgcaggatgccaggaacggctcttatttaactcgatccaggaatgccccgaatttacgttctctgaatgataccatcagggacttcaattcatgacagccccatgaccttcccggtggcagtgtcgacgtcgatctggtagaagcagggtctggtgggaaggccaggcatcgtgctcatggtgcccacgagcgggtagatgaacccagcgccgatgctggccctcacgtctcttatcggcagaacaaagccggtcggggcgcccttcatggacgggacatgtgagaatgagtactgggtcttcgccatgcaaatggggaggctggagaacccttgcttggtgtacatctcaatctgcttctcagcctgctcggaatattcaacgccactagcaccatagaacttagcaattgactcaatcttctcctttatgctagattccaagggatacaaaaacttcagaggttctgcctggctttcgcatgctcgttgaacagcaagtccaagctcaaccgctcctttaccaccatgggcatg

SEQ ID NO: 16384 - DNA, 623 bp, Zea mays
  Clone ID: LIB3279-230-Q6-N6-B1
aaacccataactgactagtcactagattagtcaatgaaacaggtacagagagttgtgacacaagtgattagcaaaagaaaagcacgtaatagctagcagcattcggctttttctttgctaatgcactaaactaacaacctcacgaaactaatagatccccttcataaacacctgttccaaacaacttaacattaaagatagcaaaccagtgagctaattggggacctaacaatcgatttgctacctcacgacagcggagatactatttactcgtcgtcgtcgttttcctcgtcactaccgccatcctcatcatcgacctcggacttcgagccatcgtcgtcatcagtcttagccttctttgagcttgtgctctccttctcaatatttgccttagtcttctcatagtcctgcttcttctgcccagcttggtccacatagggttgcttctcttgctctgacatagagcgccacttttcccctgctgccttgctcacggccgcaacgctcttgttgctagggtgctgcgcctggtactcctgcctgaattcagacatgaagacgaagaagcggagggagggcgcttgggcttgccgctcgcggcggccttcttgcgctttccggcg

SEQ ID NO: 16385 - DNA, 625 bp, Zea mays
  Clone ID: LIB3279-230-Q6-N6-B11
ctagaacacgtttcaggtagctgctatgtatataagtattatttagtccataacctgggtgcactactatattattagctaattaactacgacaggtcgacagtagctaggaggaccatgcagttcacaccctacgtacctgcagcgacggacatcattcgcgatatatatataaagatcgatcgacatagcaataacataatgcctagacatgccacatgcacacacgatcgatgagagttcttcgatgcatggatggatataatagctaaattcaggatattcaactgctgctgctggtggtggcggcggctgctggcgaaacttaaaccggaggcggccgacgttgtatgcactgagagaatagagatggccgccggtcgtcagatccggatctgcaggctaccagatgaagctcatctcggagttggcgcgcgcggcgtcgtcgtcttcctcgcgggacggggagtggacgtggcggccctcgtaggtggtgatgaccatgcgggggtcctgggcgagccggtccacccgcttcttcacccggcagttgtcctgcgtgcaccggtagtagctccttgggtgctgcgtgttcttgacgaccttgtggccgtacttgcgccac

SEQ ID NO: 16386 - DNA, 640 bp, Zea mays
  unsure (1)..(640): unsure at all n locations; Clone ID: LIB3279-230-Q6-N6-B12
tggcacgaaacctaacccacccaagcggcaaccatggagccctcccccgtcggcgccagcggctcggcggagcggtggcgcgcggaggcggcgcgggcgttccagcactacctggaccgctcggcgccgcacacggcggggcggtgggcgggcacgctcgtggccgcggcggtgtacgcgctgcgggtctactacgtgcggggcttctacgtcgtcacctacgggctgggcatctacctgatcaacctcctcatcggattcctgtcccccatggtcgaaccggagctcgaggccgggcccgggctcccaaccagcggctccgacgagttcaagcccttcatccgtcgcctccccgagttcaagttctggtatgccgtcacaaaagccttttgcattgcctttgtcatgaccttcttctctgtattcgacgttcctgtcttttggccaatacttctctgttattggattgtgctttttgtcctgacaatgaagcgacaaattgtgcatatgatcaagtacaagtatgtcccattcagcataggaaagcagaggtatggcggaaagaaagccctgcagccagtgcatctaaggagtaaagacngagggaggggtgtgggacctcgagagcagtgcctgtgct

SEQ ID NO: 16387 - DNA, 611 bp, Zea mays
  Clone ID: LIB3279-230-Q6-N6-B2
attaacacgattaatagacgtaacttagaagaacaaagtcgacctgaaactacttccccaaagcatttccatatgcgagtagcaaaaaagaaaaacaggctcagttagttctataataacaaaatggctccccccgacctctgctcctcaaacaaaacagtcagctcgagctaggcgtttgcacccagctcaaccctcccaggatggccatggccgcctgcctgtgcacctccaccatggttgttgtaataagagttgcgaccaccccggcctctgttgttgtagttcctcggctggtagtatccagattcgtagtacccaccgcctccgccacggccattctggtatccaccgccacctcggccattctggtacccacgcactccacgaccattaggatagcccctcctgccgccaccacgaccgccgccactacgctggttctggtaagagcgccgctgggtgaattgttggtctttttgttcctgatcgtccacataatcgtcaaatgtctcctgctctgcctcagctgaaggaacttcatgagctgggttcaccaggccttcatcatccacatgttcagcgtcaacaacaggagcctgatggtcact

SEQ ID NO: 16388 - DNA, 201 bp, Zea mays
  Clone ID: LIB3279-230-Q6-N6-B3
ggggccccccggggggggggggttttttttttggtttttttttttttttggttttggggggggggcgggccccctggtcccggggggccggggggggtgttgggggggttttgggggcgcgggggggccccccggtttcccccctgtctggggggggccttgtttttgtgggctgtgggggggggttcctcccgggggggg

SEQ ID NO: 16389 - DNA, 604 bp, Zea mays
  Clone ID: LIB3279-230-Q6-N6-B4
aatctcatctcttatcgatttgaattaaaaccagatgacaacaccataaacaaaacatttagaattccaaattgctcatatcctcatgggctcttgtagtaaattgtcctaatctcctagcaagcccaagacgcaagcataatattaagcccagatccaaatgtagagtattactgaaacgtgttacatctagtgcgacttgacatactcctgcactatgttaaggccctcagattcttcaccgtagtccttgacaacgacacaggagcagcctacaaccttccttgccttgccctcggagtcaatcttgcaaagcccagcccactcgccaagagtcttagcagcaggaacagtgacaaggtgaacattgtgttcagcacagagcgccttcaccagcttgacataatctggctggtcacagtcctcagcaagaacgcaaagctgagcagcatgcttctcaatggccttggcagcctcgcgaagacccttcacaagtccatcatgagcacttgacttcttcatcaccagctgcagcgcagtcatcaagtccattggctctccaagaactgggggttggtgcctcaactgcaactggggcctcctg

SEQ ID NO: 16390 - DNA, 612 bp, Zea mays
  Clone ID: LIB3279-230-Q6-N6-B5
tttttttttttttttttttttttttttttttttttttttttttttttttttttttttttttttttttttttttttttattttaaaatttttttgtttgtggggggggggggggggggggggggggggggggggggggggggggggggagggggggggggggggggggggggagggggggggggggggggggggggaggggggaaagagacggggggggggggggggggggggggggggggggggggggggggcggggggggggcggggggcgggggggggggggggggggggggggggggggggggggggggggggggggggggggggggggggggggggggggggagggggggggggggggtacgtggtgcaagccccccgggtcaagggggggggggggggggggggatgggggggaaaagcggggggggttaaggggggggcgcgggcgggggggggggggggggccccccgccgggtttcggggggggaaaacgggcccccctctgggggagaggcgttggggaggggggggggggggggggggcccccggggggggggggggggggggtgctctgggcccgcggggggggggccgtttggggggggc

SEQ ID NO: 16391 - DNA, 605 bp, Zea mays
  unsure (1)..(605): unsure at all n locations; Clone ID: LIB3279-230-Q6-N6-B6
cttattacttctaatatttattggtaatttacaaacaactggctgatacataactatacatatctgggagcatcccaaacatgatctcatctgctcccccctttacatgctgcaccccttcctgctgtcggaaattctcagcccggccatggctggattcagttccagcgtgagaccaccagccctagctggctcggggagagagtggtatgcgatcgtcccggtcctggatgtcgagaaggttgggctaacggtgcaccggaggattcgagagggggggtttacgcggtgaccgaggtctccatggcgacgcgctcggcgtagagcacgtcctccgccttctcggcctcctcccacagccccggcagcgcctccctgacgttgtggatgctctccagcgcgtggtccgcgcctttcacccgctgcgacttgcccaccagcactgtgtgaaggccgatctgcttcccggcctggatgttgcgtacgctgtcgtcgaagaaaatcgccttgtgcgggttgacgttggcgatcctgagcgcctcctccatggcgtcgacgttgggcttgcacaggacggnggtcttgggaatgctcgcggcggcgcc

SEQ ID NO: 16392 - DNA, 612 bp, Zea mays
  Clone ID: LIB3279-230-Q6-N6-B7
gaccaaagaagcgcctgctatttcatgacctgatcgcacaagcgcaggtaaggtttcaaagccgaaggtacacccagctaatgctattacaaaaccgacaaggtaataacagatccatcgctccaacgcaaaacgacagccggaggaggcaaggtctgcgcttctagttcagcttctcgattagttcgttgatcttgtcgccacggtcgcccgagtcgccgccatccttgtagggtttcctcttcatctgcagcctcctctccggacacttgagcctgaagggcatgaggaacctcgatgcttctcggaagtgcggcccaaccgtggcgatctcgtgcacaacgtcttccaagcatatgatgccgtgatctccaagagccttctcaattagatcgttactggtaagagggaaaggctccttgtcgaaaaacccacggcccttcttgtaaataagctctttcacgttcttcaagtttggaaacccgtaggtgacaaagggttcgaccacaagaagcctcttcagcgtcagctcggtggccctgaggaatacgccggtgaggaccgtcgtcagccgtagcttcctcaaaaccatcctgatgtgcggatgcaagt

SEQ ID NO: 16393 - DNA, 624 bp, Zea mays
  unsure (1)..(624): unsure at all n locations; Clone ID: LIB3279-230-Q6-N6-B8
agaaacataccaaacacacgctcatcaaggggaattattacaaggaaacaaatccggaagaatctcgtgcctggaacagctagctgtttgtacgtgaattaacgaactagtaccataatgcacaaacatgtgtgtgctgtaagaagaatgatgacgaagaaatcacaaagtctaagacgaccggtagatgctctagaacatgatcccggccgcgacggcgacgggtagcgcggcgagggcgacgaggcctccggcggcggtgacgcgtcccgcgggggacttggctgagcccgtcggcgtgttggcaggcacatctgggccgatagaagatggagagaggcctgccatgggcgccgcagtaggcaccaatccctcggggatagggaatccgaaagctgcgcaggcgctaacgggcggcgcggtgaggcggcagatccccgggagcgcgagcgcgcgcttgtagtcgacgctgacgccgtaggactcggcgccgccgcccagcagctggcagaggcagacggngtgggactcgagcagcccggccagctccgggcagcatgccgtgtccgggtgccgcgccttgctgcccgccgtcacgtacgtcaggcagtccgacatgttgag

SEQ ID NO: 16394 - DNA, 325 bp, Zea mays
  Clone ID: LIB3279-230-Q6-N6-C10
cctgcttcaatttggtttaaatctttaattagaaacacgcttaatgctccaaggggatctgctctgttgcaacaataaaattggcgacacttgtgaagagccttttaatactaaagtaatcgaaggtatactctaacctggttttctcgccatgaacttgcttatgtcaatctgcaacttccctagctccccaccttatgggaaactaaacgtgctagcaaaatttgatgctggaaaacaatcatcagcaatccttaaccagtacttttggcttatgtcataagaaaagcatgacagctggcaaggacaaccaagggtgatccac

SEQ ID NO: 16395 - DNA, 626 bp, Zea mays
  Clone ID: LIB3279-230-Q6-N6-C12
gaactgaaattaggtcataaaatcctattgacattggcataaatatgtatacaaaatagcataaaatttttgtatctctcagcgcatgaggttgtcataaaacgcatcaacaaattttgtaaattggtgtaagatacaagtgatctgaggtaattgtagcgtaaaatgcaagctaaccatctacaggagaactgtttcagattttgcaataagatataagagataattattcctgtactcaactatgataatgtcgtgtttacattttagctgttggtacatacaaacaaaactttgtttcaccataacaccactgttagcaaaaaaatctgagttcaaaaaggctattccagctttcctaatgtggagaaaaccaccgaggtccatatctgcaaatgtaacatgaactgttaatatgatctttccttgttaatatgtcttttcaagtttgttatgactaccataacctaaagtctaaactgaatgcaaacttgagttagaagatcagattaccaaaataaaaatatcttgagttagaagatcagattatcccatgtgagtaagcataaaaatgatatcaatgttcataaatatatcccatgccagttatcccatgcaaaccaaaa

SEQ ID NO: 16396 - DNA, 612 bp, Zea mays
  Clone ID: LIB3279-230-Q6-N6-C2
aaacctagtctttttgtcttattactctccacagtaccgcaacatgcaaaaaaactaccttaatgttgttcaaagtataggaaataggctgcttcgttaacaatgatagaactaaaacaaaaaggcaaaaaaaacaagggttacaacaaactcggtgtcgtcacaggggtatgtaagaagcctaacacgggttccaagacaccaaaaaccagtcacacaactagcaaagcgacaataagtaaaatctgattcactcccatgatgagccccatctcacgaactccagtaccgaaagaagtccataattcaggcagaatcaataggttttgatttgcagataccgcaaaacctgcagcatttgcaccggtatggtgccgaccagcatgcatgatgcttagttgtcatttgatattccactttcagctactggtttggaggcatccgccgccacctcagcaggagtgccttccttgcacgttgcctgtttctgtgaccctggtttgccattagtcgcatccttgtctttctcttgagaaacatcgcccccctggccttgaagcagttgctgattcgccctcttttcctgcatcaacttttggcggttctcgtaaa

SEQ ID NO: 16397 - DNA, 537 bp, Zea mays
  Clone ID: LIB3279-230-Q6-N6-C3
cccggacatggtaacccagggcagtcttgacaagcataagcatgtccgggttcagaagagagcattggggggcaagaaaaaccgctgcaagaaacaagctctggcttatcctaaatctggctggcgtactaggaactttccgacacaattccaatagaacgtttttacagttcctggatccccacgtatagaatggaagctagatgtatctacagctaccaactctaaatccattggtgcgcaaaaacggcagcaagaaattatatcaggtaagttcccgctgccgatctgccaccccggatgagccttataatttatattataatttatagcaggagtgatggtcagggggcggctgccttgatgctcaaaacacatcggattctcaggggttgaaggcgaccaacagccgtcaggtttcaggaaccttgtgcacctcaagcaatccccagtactgctttattgccttcaattggagcgactaatcttccaccgccgtgttgaagacgaaactagggaagacggttgtgatgtccc

SEQ ID NO: 16398 - DNA, 598 bp, Zea mays
  unsure (1)..(598): unsure at all n locations; Clone ID: LIB3279-230-Q6-N6-C4
aagtccagctgccaagagaagcatcaaaaagctgtggcaagaaccaaatgtcaagaagctaagggagaaagatctagcaacttgtgacagcatccgcttccgctaatttgtaccattgctcctccattcagtccattgtgtctctgtgtctccatgctcattacaaacaagcagtcatctctctcatacaaccgcatcaaaagcccctctgtggccgctctgctgcaacattcactcgaagagggcggccgtccaattcctgtccatctagggccgaaatagcatcattgagttcctcctttgacaccattgatacaaaaccgaatcctcgtgagcgcccagtttctctgtcgtagacaaccttagcatcaacaacttctccatgctcgctgaacaactgcaccagcctagagtcatcaacttgccatggcaagttgccaacataagctctgaaagctggtgcaaattgtctctgaggtctttccatgcgagtgcccctagaagatgccctgtttacattcagaagcctcccgctaatatcatagcggttgaacatctcaatggctntgtcagcttcctcaacagtgctcatggtaac

SEQ ID NO: 16399 - DNA, 603 bp, Zea mays
  Clone ID: LIB3279-230-Q6-N6-C5
gttgcccaaaaacttcaatgtaatctatataatcgagggtcaaatatacttgatagcaaaacgacagtacagtattgcttaaaaacagaaattagttccccctcgcaaatctcattttaacaccgatccttctcttcatataggtcaagccaacaaaaaactcagtatcaacacggcatgctctgctttataagttataaccggcgcactctactcctgcaaccaattattcaacaagtcacatgccatgatgcagtggtagcttcaaagtagcttctcctttccacgctctggaaagattatgcgacatatggctctccaagaagaatctgcacttcctcattagtcatcgaggtagtagtaggacccggctgacttctgttccctgtcctttgtcgattccaacttgtttatacgtggcctatagttggttgggtctcttctaaaagtgatgtcgagatgcgataagaatttattcatcccagatactaaagactgtggtgcgttggcagtacagtcaatagaaggtcgcccctcataaacaatgaccttgtcagccaagtatgttgccatgatgaaatatgctcaacataaatgcagttt

SEQ ID NO: 16400 - DNA, 619 bp, Zea mays
  Clone ID: LIB3279-230-Q6-N6-C6
atcaatatcacatcagagctcataattcaccaaagaacactacaaaacctgcgtcatcgcgagtcaacaccagacaaggttatggaacatcgaagcaaaaaagcacggaggctagccacagcggccagatctacacggtaaaatagcaaaaccagaactgggttccaccgaagcattaagcagattctgtgaaaattcgttccaaataaacttgggacaaacaagtctaagatgttattacagatatctgacagcttggatatgtaacagcaaaagagttggggcgctccaaaattaggtcctagaactagaagatcacccttttcacttcttcgccttctttggtgcagctgcagccggagcagtagctgatactggtgctgccgcaggttcccttgggccctgagccaatctctcctccctccttgcgatctttctctcacgggaagccttgctcttggcccgcttggcctcaaactgatccgagagagtcttctctctggccttctcggcctttgacttgtggatgctctccatgagtaccctcttatttttaaacatatttccttttactttcatgtacatatcatggtacatgtgcttgtcgattttctttgct

SEQ ID NO: 16401 - DNA, 317 bp, Zea mays
  Clone ID: LIB3279-230-Q6-N6-C7
aataactacgataaaacgtcattatctagctctacttcattagttcagcaacaggtaacagggtgacaggttccttacagaatgagctgttaagggttacattggagttgagggatcagatcagggtgttgtaactcagcatcagttctgtactgtaacacacgaccagttaaggctacatgctaaataaaacactaagggtttttttttttacagcagaaacgaagctaacacgacggtatgcgcctctgccacaacgctggggtggtgtggagggagcggggagtgagttccattccatgcctgctgctctctcg

SEQ ID NO: 16402 - DNA, 616 bp, Zea mays
  Clone ID: LIB3279-230-Q6-N6-C8
gaagtaatagtgaaatgatcaaatgtttcgataccgaaggaattcaatgtcacaggagaaatccaaacagttgaaagctaagggtgtcattgaagccattgaagcaatccggcagcagcatactagagactgaggtatatacacaggtttacaatagcagcagccccatcatgctcgtttatttacagtggcaggggcgattgctctaggcagagccgaaggtgttttcaccactgtaggtcatgtaaaggaagccatcctcgtccttgttctcttcgtagattgcagacatcaaagaggcagttggtggcaaggtgttcttcacaaagacaaagatggccttctctgggctcagcttgattctcttcctcaccacatagacaaactggccgacagtgagatcagcagggacaaggtacttcttcttatcaatctcggggacatcagttttgccagctttctcaacaatcacaggaattctgtcgggatacttatccctgatcctggcagattcggactgccttttctcgaggtcgtgctccattttgaaagaggtcctggccatcgacaaccggacgacgaggtacgatcaatggagccgatcgggtcgaggggt

SEQ ID NO: 16403 - DNA, 614 bp, Zea mays
  Clone ID: LIB3279-230-Q6-N6-C9
acaaagaagacaaaagcataatgataatgctagggagtacaatacagagtttttttattacagtacataatggcattcacaaactgaaggtaagcaacaccagctttattcacatactgcttaccatctcattagataagatggtagaacagctgctgatgccttagccactagccagaacagctgctgatgccttagcctcatttggaatggatggctccgaggaaaccttatttctgagctgcatagctttctggtacatagatctcccctcctgcttcaccatgttgttccccactaattgttttccttgcagccaaaaattcagcactcatagcattcattccttgtatcacagcttcctctactgttccataaccattttcatcagcatacttcctgatatcctccgtgattttcattgaacaaaacttgggcccacacattgagcagaaatgtgccactttggcaccctcagagggcaatgtttcatcatggaaagccatagcagttactggatccagagataaagcaaattggtcaagccatctaaactcaaaccttgccttgctaagtgcatcatcccaagcttgtgcatagggatgacccttcgc

SEQ ID NO: 16404 - DNA, 543 bp, Zea mays
  Clone ID: LIB3279-230-Q6-N6-D1
ctgcatctcatatcagattttagattttacaggcaaaacgcgagtttgctgctggctgctgactcgtaccaggtccaggttacagagcaagaagaaaacagagaggaacaggaacaaacagacaacagagtgagtgagtgagtgagagtggcaaaaaccaccatgcacctactagccacgacatccactttactctacctaatgcttagccttcagccttgatccgaaaaaaataaggggggagaacctagccatgaggtcagagatcatcgcaatccggtcgccgccgtaggatgatggggtatcccttgagggtccgggtgggggggaaaaaaacaatcctgtcctcctcggcttcctcccagctaaagcgcgtgacgaggtggtggaggaagacggaaaccaccacccgggcgagctcgtagcccgggcacagccgcggcccgccgccgaacggggtgaacagactggccccttccgcgctctgcagcttgctcttgccctgctgccatctccaaggtcgaaggtccgggcgttctcgta

SEQ ID NO: 16405 - DNA, 602 bp, Zea mays
  Clone ID: LIB3279-230-Q6-N6-D10
attcaacattggttttaaattttaagcataaactacacataggatatatcttaataatccacaaaaaagtaacgaacaagtcttctttacaaaacctcaacttaatcctcaaaaactcctattgcagacgaagcatggagcagaccagggtaacctgcctggtgcggaatatatgtttaccgatggagatgctggtgggcgtgtagcccagctcaaatgatgctcctgggcccttcggttagggcaaatggtgcatagtgacgaggtttttcgggtcggtcacctcccctttctcctgtcctctctatctcggcttctgtcgtggtggtcgtctcgccctcggcttgcacttttctcgcgtaccctatctcggtccctactgcgattgtgctctcgatccctctcctgagacttccttggaggactgcagcttctactctggctccggcgacgtttcctaggatgatcatgtgcatcgccatgcctctctttccgctccgacgacgatgatgttctttcagaagatcgcctgctgttagcaccatcagttggagtggataaaccatattctgactggagacgtcttcgatggctggcaacct

SEQ ID NO: 16406 - DNA, 467 bp, Zea mays
  Clone ID: LIB3279-230-Q6-N6-D12
ggggggaatagctccaggctgggcttttcattcaccagtacaaattccctgggggcaacaaacatgggatatcatgaacgcggggtttctgccctttttcccttatttgcgaaaaccaccgcaaggaaaaccctcaaaatccacccggaaatggggcaggcttccccaaaagcttgctgctccttacgggaaaagtcgaattccttgggggagtaatacatgcaaccagcatattcatccatttccttgggacacttttggggaaattctttcaacaagctgaggacccaacgtgtgacccggcggcccttttcgaggcacttttcgggggtaggggccctcttcttgcagttgaagaaaggaacgttctccgggcgggacccgaccccgatgtgctttgaccccccccttaacacccaccaaatcgggatccgctccccccaagcgtctaccggggtgctgctccc

SEQ ID NO: 16407 - DNA, 482 bp, Zea mays
  unsure (1)..(482): unsure at all n locations; Clone ID: LIB3279-230-Q6-N6-D2
cgtaagncttggncanncctctataagcggcccgcccttttttttattttttttttattttttttttttttttttttttttttttttttttttttttttttttttttttttttttttttttttttttttttttttttttttttttttttttttggaaaaggcccgggcgggggatgtttaaccccatccaggcattaaaacaccccatatggggggggattcctttacacgggggaagggaggggggcaaaaccagatcaaagttttgggtacaggaaccgctccaggggggccaaaggaacaggggggggaaaaaggattttgttcctggaccttggtttttcaaaccgggtccaatttttggggaggcaaaaaaaccttccctttggccccctgaaaaagggcaggccccttttaattcggggttcccttggcgcctttttccaattttttaaagggcccaaagaaggttttttttttgg

SEQ ID NO: 16408 - DNA, 611 bp, Zea mays
  Clone ID: LIB3279-230-Q6-N6-D3
ggaaccaaacactagattaaccaggaaaacaggaattcgaagtaacttcaaagtttagacctgcatagacaaaatcggctgtgcatcatacagaatgcgtggcccactatttcttttccttttattaccggaaagaactgaatctacacgcaacattacaatgaccatttctgatgcattactacgagcttgggtacagggcatatgttgccttcaggtagtctatgatttcagcgctttcaaacatctggactcccgtgttaggatcttcgatgtacggcgcctggaaaagcccctttttcttgaaaaattcttgtcgtttggggctgccacgtgcgcagctgtgtagcagatgtggcaattccaactcgacaagcgtctctcgtactaatttacagaagggagatccctcatatgcccatatctctatgggctgcgatgggacttttgaagcaatgtaggaatttccctttccaatacgaccaagagtagcaagccctgctgtaattgccgaagcatgtgtcaacagaccaagtgatagcataattggaacagttccatcgccatatgtatcagctagatattttatgatgtcatcggattcatacatg

SEQ ID NO: 16409 - DNA, 399 bp, Zea mays
  Clone ID: LIB3279-230-Q6-N6-D4
gataaaacaagaattcttaagtcgactagaactgttaactttgacgacagccactgaattcaggcagccatcgttcatgagctacctctcttacagacaacaccgagaagtacttaagaagaaaaagaaaggaaagcctgattaaaaacaacatattgtaagcacaagaatccatagctgcgcagaaatttgaccttcacaagctcgctcttttctacccttgaatggcaccgtctcctgcttttttttaatcaaggaaggaatggggggtcttcggggaaggcaattatttacagctagcaatcggagttggggactttttgcagtgacatcaggtgggataaaaatctccatgtcaatgaaggcaatcacccggctggaaccgaactttggctactg

SEQ ID NO: 16410 - DNA, 607 bp, Zea mays
  Clone ID: LIB3279-230-Q6-N6-D5
gatacaatccattgtaaaccgcttagattattaatacgaggtatagaagtacaataggaaataaggtctaaagatttgaaaagaacagaaccccagaaacaagcatctcggtactaattttcactctggcatcaagtcaacgaaactggcagtcacatcaacagtagaacccaaattgacgttctgtacaaccagaccagcgattaatttcatcatgctcgtttgtaaggaacacgatgcctccaatgcaatggaggcacaaaccaaaacatatcgtaccatttctttttactacaatacttatgtaaggtcgtcctcatcgtcctcctttttcttcagctcgttcttcgccctgagcagcagggtggttttccaaggatccagacgtgtcatgctatcaaattctttgattgcatcagtgaatttggcaacatccccttcatccatagatgcagcaagatcagctaaaagcttgtattcacgtgtcccagagaaagtcgggtcaatttcctggtatcgctccaatgaatttgtgatggcaataggatcacctctacatagttgacagatgccagcattaagaagaattcctctgacactatactta

SEQ ID NO: 16411 - DNA, 592 bp, Zea mays
  Clone ID: LIB3279-230-Q6-N6-D6
gccatcaaaaccgacagacttgtaacacatgctcaggcgaaccagcattatccaacagtccaacacagttcagctcatcggttgccacaggtgcttaatggcgagtacaccactgatcacatatcaggcgctcttattattattatttcacgatgtctcgggatgttattctagcctgctggtgagtggtgacggcactcccaggcgcccccgaagtccagcgaccattcgtttcagttcagccctggagtccgatgatcccacaagcaacacggccgccagcgtttccggtgctcttgctgagctcgtgtccaccctttccaagatcatcggggtcagcgtgaacaacaacagctctgccaatgattgagtttggcccagtcagtgggatctggctgtcggtaacattaatgtttgcaacaccatctgctccagctgtcacatttccaagatcaccggcatggcggttctcatcttctggtgctccatgttccttgctcgcaggattgtagtgtggtccagttgacatgcagccattggtggtgtcaccaagcgcatgcacatgaaacccatggaggccaggccccacgcg

SEQ ID NO: 16412 - DNA, 513 bp, Zea mays
  unsure (1)..(513): unsure at all n locations; Clone ID: LIB3279-230-Q6-N6-D7
gaacaagaatgctagggaaattaataatctgcaaactacagcgacatatttgggttttaaaacatgcgaagatacatttggctctctccggatcttaaatatgtattaacctagtaaccacacaggtccttgacaacaccggggatgggaaccctgtaaaaatagtcgtcccagtctacccccatgggatcgaaacccaagtaatatccgctgctcctgttcgccatcgccgccctcagcctttgggggttggaatcatcgaagcatcctttgaacaaggagtaaggcgcgtacagctctgcgatatgcatgacgtatctgtacttgcggctgagctcgtcggggcgccgggagagagcaccccacaggacaatgttgaggaggcgaaggatctcaaggggaagcctgaacttgatggccatgtaggccccgaagccggggagggtgcggaaaaacccatcctgctaggccgcacgggctcgctgttcttgcccccggacctcantgggttgc

SEQ ID NO: 16413 - DNA, 608 bp, Zea mays
  unsure (1)..(608): unsure at all n locations; Clone ID: LIB3279-230-Q6-N6-D8
agacaacgacaaccacgcaatcgagaaagctgatcgatccgtagtccatacatacacgcataccatacccatacatacacgcatacatggcaattggagaaggagatgcaggggacggatgatgtcgacatggatgagaacgaggaaccatcaaagatttccgtggctagctgctgctacaagagtcacaggagacgccgccggtgcggcgccggctggagcctgttgacgagcccgagcgcgttgctggtggcctgcgcgacggccaccaccctcctcttcaccctgacggcgtcgtcgctgtccttgccaccgcgggactgctgggcgagggagtcgaggcaggtggaggtgtcggtgagcgcggcgctggcccaggtctggacgttgctgagggaccaagcgaagcgcggtgtgccggcacggcccatccgctccatctctgccgcggactgccgcagccgctcctccgcgtcgcgcgccagctccgcgcagtccttcatcgcgccgccgccgccgccgnggatgtaggaggagcagttgcgcgcgcggtcggngccaacaccagcgccgttcgcgccagcaggcgcgggctgcgccccacgcca

SEQ ID NO: 16414 - DNA, 630 bp, Zea mays
  unsure (1)..(630): unsure at all n locations; Clone ID: LIB3279-230-Q6-N6-D9
tttnttttttttttgattacagaattatttactccgttctgaagttgaaagaatttctggacaacaagatatgcgacacaaatatttgacggtctcaaaccgtgctaaccacccaaagaagttcgaggtgctgccagttaatctcttaaagctaaagctcctccccatatgcgacaaaaagttattaggaagacagaacaatcagaaggaaagaaccacatccgattctcagatgtgatcacagactgcatttgtaaactcggatgttgatgcctttccaccaagatcagcagtcctgtacttccccccagcaatagtctggaggatggcgttgtggatccggtctgctttgtcgttgaattgcaagtggcgcaacatcatgacagcactcagcataagagcagtcgggttcgcaaggttcttgccagcaatatcaggagcagaaccatgaacagcttctgctagacaaatgccaccttcaccaatattgcaactgggtgttaggcccaagcccccaatcaaaccagcacatagatcgctaataatgtcaccatagaggtttggcatcactaatacatcaaaaagaccaggattcttcacaagcgtcatacaacaattgtcaataatgac

SEQ ID NO: 16415 - DNA, 517 bp, Zea mays
  Clone ID: LIB3279-230-Q6-N6-E1
atcacctaaataatttgatccttttttttggcataaacaagcgtacagatgctaccaagaatggggcacgagagacttaaggaaaagttaaaacacagcgcaaacctactaaatgagttaaactaaactcagttgaccacaaccagcctatttggatgtccatccgggaccagaccttgcttcaggcaaggcacatggaacaaaaattctggaaatagaacctccgcctacaaaaagtcccacgggatccaaaacatgactacaagtcagggggaggggattgtcagttttgtcgctcatcaccaaacccgatctttgatagcttgaaacctgtggcttccaggtaaaatatttcttattgatcaagccataccctcaaaagcaagcatgatgcgttggtgatgctcaataactttgtagtcaactacctccgaaaataactggggatccaatgtgcagccaggccggccataaacagcagcttgcacgctagccacaagctttgcaatctccctgc

SEQ ID NO: 16416 - DNA, 617 bp, Zea mays
  Clone ID: LIB3279-230-Q6-N6-E10
gggcaaacacaagttatgtaattggcaattgttcaacagagatgaatttggtccatatagcttcatccaaaaccagaaaatatggtacaggagcactccagacagcagcctaaactcagcattctacttcgcagaagttatacaagtacaggactacagggtcattttttactggactctccaatcgtttgttgtcgtctgagcaacttttgagaagttaatcaaaaggtataggaaggcgccagcccccctgggtgccaatcgattctcaatcaattaaaggtcatgtttccgagaccacctgcacatttctaatcgtggaaatcaggaggcacagtttcttctttgaagtattccttcctcacagtctcggtatcacaaaatcttaccagggaggcatatgatttcaacagaggtttaacaacctgccacattggttgaaaaacaaatggagcatcgacaaaaagaacttggccaagccgcttcgggtagtaatagtaaaaaaacgtccatcaaaaactttaggaactggagatcaccattttcaacccgaaagcctcgcagatcaaagatcccaagtatattctctgctcctggcggaagtctgttgactgcct

SEQ ID NO: 16417 - DNA, 628 bp, Zea mays
  unsure (1)..(628): unsure at all n locations; Clone ID: LIB3279-230-Q6-N6-E11
tttttnntttttttttccacaaacaggtcttaataagacaagacaatacaaaagagcaatgcactaagaatataaccatttactaaaccagacatcaactctgtttcatctggaaacatcacagcagataacaaaatagtctcagactctaagcgcggcagggcactacatcacaaatattgttcaaaaacaggtgcatttgacaactaaaacaaaataaaatattgaagtcgctgctattacagtagacgaattgatgattaaaccggcagatgaaacagtatcaccaacagccaaaaattttagagcttgtcctcaaactcagaaagaggggtcatctgttccttgagacccttcctcttgcggatatccagcaccagctgagcagcctgggagccggcctccaaaggatctgagcccatcatgtcccaatggtcaaagacacactgggggaacgcctgaccagaggttgcggccctcagttggctggagaaaccaaaggactcgatgacagggaggaaagccttgatgttgtagagcggggtacccggcctctgcatctcctcaaagacagacctctcttctggttcagaacaccgtagataccaccaagtgcattttctggggc

SEQ ID NO: 16418 - DNA, 410 bp, Zea mays
  Clone ID: LIB3279-230-Q6-N6-E12
aaaaaaaacaaggcttttttttttcctttctaaatagcaaaggacaacttgcggggggacacatccccatacaggggcgttggccccatttgcagcctacccataaccgaatacggggaacaagggcctgctaaacatcaaatcactccggacaggcagtctatgcctttttaggggacttgggggcctttttgggcaattttgcctccttgctccccccactggaccccttttccgccgtttttttgggcaaaaaaacagggttgattttggggagcacacccccgggagcgatggtcaccccccccaaaagtttcccaagctccttttttttccggatccccaaaagcacgtggcgcgaaataatgcaagtttttttgttgtccctggcagcattaccgggaagctcc

SEQ ID NO: 16419 - DNA, 537 bp, Zea mays
  Clone ID: LIB3279-230-Q6-N6-E2
gcaacctcagagaaacaaggcatttcttcttccattctaaatagcaaaggacaacttgcagcaggacacatacacatacaagcacattcgtcccatctgcagcctacgcatcaccgcatactggtaacaaggtactgctaaacatcagatcactccggacagtcagtctatgccttcttaggggacttggcggccttcttgggcgactttgcctccttgctcccgccactggacgccttctccgccgtcttcttgggcagcagaacagggttgatattggggagcacaccgccgtgagcgatggtcacgccgcccaacagcttcccaagctcctcgtcgttccggatcgccagaagcacgtggcgcggaataatgcgagtcttcttgttgtccctggcagcattaccggcgagctccagaacctcagcggcgaggtattcgaggacagcggcgaggtagacgggggcgccggtgccgacacgctgcgcgtagcggcccttcttcaagtagcgcccgatgcggccgacggggaactgg

SEQ ID NO: 16420 - DNA, 603 bp, Zea mays
  Clone ID: LIB3279-230-Q6-N6-E5
cagcttcgcgatggaaagtctggcggtgctttattcttattcctcggagcaaacagagtacaaacagtcggtgctctcggcgacaataatgaaccaataggtagtttgtacataggggatgaataccttaaacaatcaatttgacaaaaacaggcggagttccttatggctgcagtgcaggcgtgcagccggcaaccattacatagaagcagccgtaccatcggcagatgagtcgattaggctgcagtctggccaaaaagaagcttccggatctctggcaatttcttgcggaaaacaacttctagtcttgcgtcaagtgtactctcaaacacaatctttccatctcgagaagccaatacaatacctccagagcaaaactggccatgagcatcatgatggcttggggcaggtggcaggtatacatcatgatcaacaaatatctctggttcatggacatctgcttttgatgcatactcatgctttgctgaatgcagcactgattcccatgatggtgatcatccttgcggcaacggagcaatactgctggctctttcaaacggagcaaaccctgaatgattaggtctttcaaaagttcttgtttca

SEQ ID NO: 16421 - DNA, 322 bp, Zea mays
  Clone ID: LIB3279-230-Q6-N6-E6
ggaagaaacatacatgtaccagacatactagataaaatgtacagacgaggtgactgacaaacgcatacacgactagagtcatggatgatgatggatctcggacgatacgtactaagcagtgacagaaattacaagctagcatgcacaaggtactacttactaactagtagtagatgagagagattcccgtttgtcaacttaatctgcagcatgtgttttgtcccactagtcccaaccaagcagtcccaggctcccagctcccaacgccaaccaagatgacgagggctcgtcttggccgccggagcgagctgcagctacctcc

SEQ ID NO: 16422 - DNA, 624 bp, Zea mays
  Clone ID: LIB3279-230-Q6-N6-E8
atggctgaaggaatatgatatcatgaaaccggcaaaaggtggtaaatcacctagtcaattgattagacaagcatcagagtgtgacctcggtgcaaacgcaccagtatctagaatccagagcccctatatggctagcagaaaaggcctgatggccagcgcgaaccaacactccagtttgacatacaaaatatgtcttcttacataaaaatatcaatgtatcatctctctgtgctgcttctgtgcttagtgccgcctcaccttagactcactcctcgcaaggatcataccagagagcttgtcaacctcgtaaaggagtccagcggaaaacaggaagcatgttgtgatacagacacggtggacagtgccggctacaataagagctacaagttgtgcaacaacaactgcaccccacccagttctatctccactagcttcttgatagtttccaataaaggtgaggagtagcaggaataggagggagcagacgaatccaccggcgatggtcatgagctccgacgaggcgaacttggccctgtacatctccagcagcgacagcgtcactgcgaagaggagcagtgacagcagcatcgaccgccccgtgctcgccatctgacaagagactgc

SEQ ID NO: 16423 - DNA, 472 bp, Zea mays
  Clone ID: LIB3279-230-Q6-N6-E9
aaagcccatacaatatacagggggctttcgattcccagcatatcaaattatcagttgcccatgaaatgaaaaacacaggggacattgtcagaaacagcaacgggtaaaagctagcaaaaagcatttggcggttcgtcgttgccctggagggaggaaccccccctgtcgttgcaggcctcacgggcggggaaatttgctgctctttcaacggaaacgggtcctttaaactgcccggctgcgatgggcccaacggcacgggcgtgctgttgtaaacctcgcaacatttaaagggggaccagcccaactttatgctttttttgtgaaaaacaacggggtatccaaccaagaaattctggccaaaaattccaataggttcccttgatggcagtacaactaaacaaaacctggcaagccccccctgttcgtcattaaatggcaagataggattaacagcccggaaactcttgtttgc

SEQ ID NO: 16424 - DNA, 596 bp, Zea mays
  Clone ID: LIB3279-230-Q6-N6-F1
caacacaaagacatccatcgttttgcattttagttaaaacaacttgggtcaaacaaggtccacattacatctcatagatttatcttgcaaaagaaaccaaggcaataattaaactgcaaagctactaccatcaggttctatcctggcttccaacggtgtacaagaagccattgcctacagtaacttgtacagcggctggggccgatttgagtgcttgcatctggatgatcaatatgctggtgggccagcaaaggaataacgggtggacacaggcacacttgggccactaacccttgtcaaagctggcctctgaatgccctcaccataaacactagtcgggtgctcataagttgtcaggtaggatgctcccggactgaggtccattgcgcgtgtagagagtttgtaagaacggtacagctcatccacgcgttcagaccgtgcagcaagctctcctggcagtgcttggtgatctcttacagttacctcagctgcagttctttcgtgcataatatccatatgaggttgatggtatggagacctagtagccacttggtgatagtaattaagaggaacatgttgaggctcttgcatatgat

SEQ ID NO: 16425 - DNA, 490 bp, Zea mays
  Clone ID: LIB3279-230-Q6-N6-F10
agtcataaacaataccatgacattgaagtcacaatcacttggaaaaatccttacatgtgtcctgaaattgaattagcaggaagcaaccagattgatttgaaacatgaacaaatcatccttgatgctacagccttcactaccatcatggagtcatggaccaggcttcttgcaagcacaagcatgtacaccctagaagttccttgttttcttggatgcttgccccaactctgagagcttcccgttttgcttgggcaggtaagcaccaggcctggagacgaggttgatgcgggaccgcggtgcggcgaacatccagttgtcttcgtcgagagacctcacctccctctgcagcgcctccatcacctcagacttgagttcagccagggcctcgtacttgcggtagagcgcgtcgatggaatcagcgacgtcttcggcggccgagatggtcgacctcgccggcgagctcatcgcgccggctcttctcggatctgcc

SEQ ID NO: 16426 - DNA, 520 bp, Zea mays
  Clone ID: LIB3279-230-Q6-N6-F11
aaatgaaaaaaggggaagaaaaggaaaggggggggggggggggggtgggggggggggggggggggggggggaaaggggggggggggggggggggggggggggggggggggggggggggggggggggggggggggggtaaaaaaaaaaaggggaaagggggggggcgggtaaaaaaaaaaaggggaaaaaaaaaaaggggggggggaaaaacccaaaaaaaaaaaaaaaaaaggggaaaaaaaaaaaagggggggggaaaaaaaaaggggggggaggcaaaaatttttttttaaggaaggaagaaggggggcgcccaaatttttagggggggggggggggggggtggggggagggggagccccccccaagggggggggggggggggggaccgttttttttttgggggggggggtggggggggggggggggggggggggggcccccttgggctgctgggaaagggggggggggcccacgcccctgcgaagaccgaggggaaagaggggggggggggggggcg

SEQ ID NO: 16427 - DNA, 595 bp, Zea mays
  unsure (1)..(595): unsure at all n locations; Clone ID: LIB3279-230-Q6-N6-F12
tgcacgcgctacgctaagtcttggaatcctctagaagcggcncgaccctcttgttgttttgtttgttgttttatttatttattttattttattttttttttatttttttttttttttttcttttttttttttttttttttttttttttttttttttttttttttttaatttttttttttttaagccctaaagcattaaaacggggcccggggggggggaggggatatggggagaacattgcccccacaggtttttgggccccccagccggccaatggtttaggaaacccccccccaaaaaaaaaagttttaaacccggggggggggacccagggatgcccccaccgaggggaaagccctgggggttggaaaaaaaaaccccaaaaaattggccaaaaaggggcttaaaccccccgttttgagctatggccaaaagggcatttttggaaaaaagggacccggggccacgggtttggccacaaaaaggggggaaaaaggggaaaagggctcgaaattgaccccccaaccggggggggtcccaaaaaactttcttcaggggggtcaaacaaaactaggaaagggggcctttgcaaaaa

SEQ ID NO: 16428 - DNA, 624 bp, Zea mays
  Clone ID: LIB3279-230-Q6-N6-F2
ggcaataaaaaaaacttttgacgccaacagcaatagccacatgagttcataacaccagaacagaagaactagccaattatcaaaaagattcagataagtttgccagctcgtttgaactgctgaaggtacaaaaattctctctagtaaccgcccttgagatcgttgaccacatcataaggaataggagtgactgtctcgagtgtagcaccctcaaccatgaagccaggtttgggtcccacaggctgcctcttggtgctgatcacctcaccgcgggccttggcatccgccttgagctggtcattcttggctttcctcaagcggaactcctccgtgcaacgggagggctgcacatgctccacgcggacatggatccgcttcctgatgatgcggccattaacctgcttgttgatctcgacgccgatggcgcgcttggtgacgttccagacgctcccggtgcggccgtggtagaacttgtgcggcatgcccttgtgcacggcgccgttaaccttgacgtcgacgtagtcgccgatcttgtaggtgcgcaggtacgtggtgagtgggatgtaccccttcttgcggaagggccgcgcgaacaggtcgcgggtccgcgaccgcagcccgtgc

SEQ ID NO: 16429 - DNA, 526 bp, Zea mays
  Clone ID: LIB3279-230-Q6-N6-F3
aaccactgcattttaaattggtttgttttgtaaaaaaccgtattgatccaataactaactagggaacagtaaatgcaacattttgcattccaaatagttctttttgggtccattcgaagaaaggcgaggagccaccctccttatttgatgtgccaagtgctcacaaagggaatttccagtaacaatttattcaatgaaatacatttcagtctgtcctggggatcagttgccaaattaaacttcctgacaccccttgcccgaactggaggggtcattgatttgtaattttaacttttgcaagttcagctgcggcgcgagcagcatcaaatgcccgggtggcagctgcaatagcagctcgggctttctccagcgcgtttgatgaacttgggctggtggagggcatctcctcagcgggggagtgatggcccatggttaccaatttgcccttagtgacaacaccagtttttgcacctccagctggtgaagtcggaaattcgcgaacttggtgtttttcggcatcaatgac

SEQ ID NO: 16430 - DNA, 582 bp, Zea mays
  unsure (1)..(582): unsure at all n locations; Clone ID: LIB3279-230-Q6-N6-F5
ggaaaatatgagcttcaacaaatcctacaggtgcaataatgcaagataacatcacaatcataaagaaaccaggtatctgatgtcgcgttcccatgactacaccgcctaaacggaccactacaagacattaccacctgcatgacactgatgcgtactcaaagggacatgacaaagtacagcttgtgtgcctgataattcgcttcaatccatagatacttatttcacggggaccgctcctcacttggccatcataaccttgacgaactcctcgtagttgatctggccgtcgccgtcgacgtcggcctcacggatcatctcgtcgacctcctcgtcggtcagcttctcgccaaggttggtcatgacatggcggagctcggcagccgagatgaaaccgttctggtccttgtcgaagacgcggaaggcctccttgagctcctcctctgagtccgngtccttcatcttcctcgccatcaggttcaggaactccgggaaggcgatgggcccattgccatccgcatcgacctcgntgatcatgncctgcanctctgcctcggnggggttcgggcccgggggcgcatcacc

SEQ ID NO: 16431 - DNA, 551 bp, Zea mays
  Clone ID: LIB3279-230-Q6-N6-F6
gcagcaccaaaaagcaccatttttttccttaggatttaacttaaaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccggtcagttcctccagttcccgtcggagttgccgtatccgccgccacggttgccaccgccgtagccgccgccaccaccaccgtagccgccgccgccaccaccgtagccgccgccaccgccgtagccgccgccgccattacggggcccgccaccggcgtagccgccgccttcacgggcaccaccgtacccgccgccgccggcgtcttcacgggcggcgggggactgggcctcgttgacggtgatgttgcggccgtccatctccttgccgttcatgccct

SEQ ID NO: 16432 - DNA, 492 bp, Zea mays
  unsure (1)..(492): unsure at all n locations; Clone ID: LIB3279-230-Q6-N6-F8
attccaaatttatccttgtccggaaccggaaggacggcagcagcaccatgactgactagcatccaaaagcctaaccggagctgatttacatgacatcgcaagagataaacgctgcggaatatgtaggggcagaaaaggacgtgaaacagctattgctagagagcttagggtattacagtatgaaagactgaaacgagttatattcttaggaaatcttgcagttgacgcaaggctgctgctgatttgcacataactggagttgatccgaattcaacggtagttgcggtagatggggctgtacatgcagctctctgcatatttcaccaggtcctttggccgagggcgcctacttgccaaaccaagttcatatgcctttgctgcaacgctggctgcaatgtgggcagagatcttcctgatgtttgagaagggaggataaatcagccccttctcaaaattttcttctgtgacctgctgggccagcgnacgcgtggg

SEQ ID NO: 16433 - DNA, 604 bp, Zea mays
  Clone ID: LIB3279-230-Q6-N6-F9
ctaaatatatatttttttaaaaaaaaaacttcaatgtgagtacgtatgaggtatctaggaacaaaatctgggttacaagaactgctcaattggtagagatttcgactatagctctcggcctgacatcacctggacatcctaaccacttccgtgagcattagaacaagtgacgctgcagtgttgcttactctccagtctccactatgtgcagtaccaatagtggccatcagcttcatataaacgttcagaattttctggtgcaaatccgtgctaatcatcaccagatcaggaggatgtcgcctgggaagcaagaaatgccgaatattttgctcgctctgccttgtaacgtttcagctctttgattgccgccagcagcacatgcaaggaaactggtgcgaaaaatggcatgtaaatggcgaaatagtgctctactgaagcataactgattgacataatggatggatggaaaaatgcatcctcagccagtgccctggctcttgttgcagatactgctgaagagtcacttattcctagagttgcatttccctgtgctaaatttgcagcttcaagagaagctcaacctgtcttccaatttcatccatga

SEQ ID NO: 16434 - DNA, 421 bp, Zea mays
  Clone ID: LIB3279-230-Q6-N6-G1
agctcaaaaaaaaatactgctaatttatattactccatatatgtttgtagcacacagcgagaatacagaatgctcattatgcccatggtgcacaacaaactactgggattagccatgacatggtcaaaaaatagcatatcggagcagatacaaatgggacgattcaccaccatcaacaaaatctcactatggatctacactagcaaaacagcattgatacagccatcgttctccgggttgtttgtaacttgagcatatttcccccaaacaacttttccagcgggagttaccagaccaagctcactgacatttacctcaatgatcgttccccttgtcataacaccaagagaagtgtacattggaccatttgggtttttcttcacagaaattatgtcaaggttgaaagtgcacttcagctctg

SEQ ID NO: 16435 - DNA, 604 bp, Zea mays
  unsure (1)..(604): unsure at all n locations; Clone ID: LIB3279-230-Q6-N6-G12
cagagcagaaatcacttcagtattcataaattcacccaaacggcgacgaaattctcaccaaacaacataaagatgaggtgaattgtatcatcgaatcctcataaccgtgcaacaacataccacttttatttaaccaaggccatagagtgcccagataaagtactgaagttaacacggaatcaggaaaggaacaggcgaaacggttgcgaaaagagagacggaatggagctggatcctcaatgaagcttgtgcttgtagcgcgcaacctcggcgtcgttgggaaagaatcccattaggcgcccggcggagttctggtaggcgtacatgaaccctcccatgaccccgatgaggccgcccgtgaccatcgacgggccccggatccccggcttgatcccggagaggtagccaacggtgacggagacggcggagatggtggagaggcgcatgtagtcgagcgcagagaagttgccgaccaccttggtgaaggccgggttccgatccccaccgggtactccggcttattcgaggcggtgaatgtcggtgttcatcgcgtggagcaagggagacggcagatcccctccgtgacnatggctgcggcggcggt

SEQ ID NO: 16436 - DNA, 500 bp, Zea mays
  Clone ID: LIB3279-230-Q6-N6-G2
agtagtgaaattccatatattattgtaccacaaagccatgagaggcatacacaagatatatataatataaatttatatcgccgctgttgacactggaaacctgcaaccagcagctgctaagcaactaaccacttcactaataaacaccattactagtagcgaaacagggggggggggcactggtactactagcaagcactggtacagacgaaacacaaacaattcctttgataaatacttaggacaacaaagcaaacgcccttattcatggagcccacggcaagcttcttttgcaagtaaaaaaaggtttgcaaacagagggacgagagagagagagaggctcttgctgcgtctgctggtagcccaccaaagcaagcaaaagccactcgtggatggatggggaaacgacaggttgttttcctatcatctccatgagcggtaaatccctaatccaacatttttttttcaaatctcaacattcttgcatcagctaacacctc

SEQ ID NO: 16437 - DNA, 609 bp, Zea mays
  unsure (1)..(609): unsure at all n locations; Clone ID: LIB3279-230-Q6-N6-G3
ttctttttttttttttttttttttttttttttttttttttttttttttttttttttttttttttttttttttttttttttttttttttttttttttttttttttttttttttttttttttttttttaaaaaaaaccccgggaaaaaattaaagggtttttccccccgcccaaaaaaggggggaaggggctttttcccaaaagggggaaggccggggccaaaggggccaaaaaaataaaaaaatagggggggggtttaaggggggggcccccccggaaaaccccttgggggaaagggccccccccccccaaaaaaaaggggccccccccccccccgaacaagggggggaagtaaaccccctttcccccggggggggttttccgggaaagccccttaaaggggggccgggttatgttcttaaaaacgccccccctttaaaggaggggggggggcttccccccaaaaacccaaaaaaagggggtaccccaccggggggcccccccttttccattgaaaggggcccggaaaaaaccccccccaaagggaaaaaaccgggcaaagagaaattttnaaccccttttcccaaaaaaaaaaaatggggggggggggg

SEQ ID NO: 16438 - DNA, 450 bp, Zea mays
  Clone ID: LIB3279-230-Q6-N6-G4
ggccgggaagagggctcaaccccgaccaaaaggggaccacccgtggcaattgcaaagccccaatctacagccccccaaaacaggaggccccacccaccccaatttagggtttaaaaaaaccaaactatggcaacggggcaaaacctaccccacaaaggcccccccccttgggggattcaacccacgggcccaaaaaactaaacccagcccggccgggcttaaaacattgcaaaaaccgcctctcgctgaaagccccaaaggggggagggaaaacataaaatcaccctttttttcgccttcccgagcccacaaaaacggccaaaaaaaaccgccccccccccttgaaagaacccaacggagccccccccccccctgaaatccctaaggccgccctctttgggggaggcgaattcttaaaaagccttttttccttccctgcccgcccctttt

SEQ ID NO: 16439 - DNA, 622 bp, Zea mays
  Clone ID: LIB3279-230-Q6-N6-G5
gatatgaattaatttgaattggtcggtgcctcatctctgtccaacgaggagtcatttgcatttggcatcgcagatttttttagcatatgtagtacaacaggagccatgcattctgtttcttttttctattaacactactacacaaatcatcgggccttatttactgtgaaattcttcggacaaaccagaatgtgtacgaaacaaataggcatacatcgtggccttctatgtcatgctacatacaacatgattccaagataaccaaatcaatttgaatatcaatatggttgctgcctccgtttcagtatggggacgcaggcgcatccggctgtttttcaggaaccgcgacttgaaatgctgggatctccatataggctttgtagaacctctccagaagagggtactttgacatatcaattccgaagcgcgtcacgcctgcatacatctggggcgcaagaaacacatctgccagttggacttcgtctccagtagcatatttactgtcacaaccttccagaagtttttcgattgctttaaatcccttgtcggtgtaattccgaacaatctgaaggctctggttagagcctaaggtgccatcaagcagaccaattacagcataaca

SEQ ID NO: 16440 - DNA, 465 bp, Zea mays
  Clone ID: LIB3279-230-Q6-N6-G6
gaaaggggttgtgttcccaatttccagcaaaaagatgtgtagcgccatgtcatgcatgaatttgtggttacaaactattcatagatacatggtacagcttgtacagtgacagaaaaatcgatctgacgttgctatgattcagagaattttatctgcgacaagactcgaactaaacaaatgtgtagttcagatttctgtaactcagctaccatcacgatcctcagatatttttcagctgtgtgacgtcatatacatagtaccaaatcatgcatcagaacaaaacaattaaccaaaatgtttccttttctgggcctctcgaagtttccggaacaccgacgcttccaaatcgttaaatccagttccatcagtattgcttgtccttgattcatatgtttctgttggtcttgttgataatccaccggattcttgaacaggagcaacatttaacggaaacagagagaaatg

SEQ ID NO: 16441 - DNA, 395 bp, Zea mays
  Clone ID: LIB3279-230-Q6-N6-G7
aggacaacattggtttctgattagagtgagtatttagtttctgatccaccaaatgatcagctaccgactactccttggcgtaggattttacatgattcctgacgcttactagccacaggaaagcagacaaatttcatgctgcagcgtacgccagggattaaattcagactaaactacttgcatcttgggtgcaagactaatcttcagttacttctgctgccgctgcggatatcagtgatgctgactggatctttccggcatgctccagcctcatcagaatcactcccctcgagcgtcgagactggacggatatatctttaactttgattctgtttgcagtgccactctggctaaccaaaacaacctgctcgtcactttcaccgtcttcagtgagc

SEQ ID NO: 16442 - DNA, 442 bp, Zea mays
  unsure (1)..(442): unsure at all n locations; Clone ID: LIB3279-230-Q6-N6-G8
tacggggatataacggggtcctgcgataatcactcatgaaacataaaacacgtgttccattctacctgagcagtcannagcctcttgtagtgttctgtaatggctnaacgctttcnnctttccggtcacctcnncgacgccgcagggctgcttctttttctcggcctccgagnngggccacttggcggtgcctgagtttcttaggcttcttctgcagagctgccnttggcgtcagtttgcttggggccttgccgcgcccgtctttaggcaccaccactcctttccaaccttctttgagagccatcctttgncgccctctttagcagcaggtgctggtnggaggttgcaacatatgtggcggtggagcgtgcttcagcttcactaagatatggcgcatccgggagaggtcggtgggcttgccaggcttggggccctgataact

SEQ ID NO: 16443 - DNA, 613 bp, Zea mays
  Clone ID: LIB3279-230-Q6-N6-H1
agcataacatcccatcattacttcgctggtcattacaatgatgcgcagttgaaattttacagaacctcaaaatgggctgacgacgaatctccctctcgctatacgaccagtcaaataatatactaataaacacaggcggcaccagggtgcactccacataatactctgctgttactcagcggctacattaacaggaccatagttagatgatgatatctgcctgtttaagcagcggcaatacgaaagagcaactaactattcaactacgtcgtgctttcagactcgtttgtagaagaggacatatgcttggtcatgcaagacatccttctcgccaacgggcacaacggcgtcgtcgtcgaaacgaagccattgcccgttgccatgctttgcgtgagcggtgtagtgccccctgtaggggtccctcccatgatgagtgatggttgcaacaagctcgtattttctaccctcttgtgatggtgagctcagcagatcacgactaagaaccagtacggatggaaagtggagtggcttatagactttagtgctcccatgatttccataactgaacctcttcaagtgcagtatcattatctttgaaagtgcgtgtatcttg

SEQ ID NO: 16444 - DNA, 620 bp, Zea mays
  unsure (1)..(620): unsure at all n locations; Clone ID: LIB3279-230-Q6-N6-H10
agaagaagaattggctttatgaggtattaggatgatcctgagtacatctttagttctaaaagcagcgacccaattatcacatgcattatcaaaagtatagctggaacgaacaacagagggaaagtgactcaaagctcgattctgtgggcagccgatcacatcaaaacttgagttagggtagattctgtagaccattgtaggcagccgatcacatcaaaacttgagttagggtagtaaaagcagtgtagcagagatcctaatcacttggagatttgagggtggtgactgaaaagctccatgtggtgtggacacgtaggtaacgatgtctaagcagtgaaagcgaagaccatgtcatcgatgtccgacttgacattgctgtagatgttgtcgatcagctcgaagatcaccagtgataagttgctctcgacgccgtggccgcggagcgccgcctgaacgtcgacaccggtgagggcctccttcctgtcgaacaccgtctctctgtcaagaggggtgccgccgcaagcgctggacaccatcttgcgcatgatctcaagctcctncgtgatctgcagcgccatccaccactgggcacaccccccctccgcataccactttactga

SEQ ID NO: 16445 - DNA, 516 bp, Zea mays
  unsure (1)..(516): unsure at all n locations; Clone ID: LIB3279-230-Q6-N6-H11
ggcccaagggaaaagggcacatcacagtaatgccaaataaaaaaaagggtagaggcctcaaacaaaaaatacataagaaattcttttgtttgggcgcggggaagcataccccacccacaataacacgaatgggtcctcggtatgatcttcaaaaaagcttcaggctgaccaaaaggatgctgagcgatcaattaaacgtgtcgattggcatttcttgccttttcgggcaagggaccgctctcgagctgcctggattttactggccacctttgattgttttacacccacgtcattctttgacgagttcacttgcttattgtctcccaaaagttcaaaatctcccggggcactcgaaccaccacttaatctggttatgtctaatttggcgagcttctttaatataggctgaacccaagcttgctcgacggggcaaacattttttatgtatggaccagttgtacttatcagctcatgataaataacgtacattnggaaactttccatactcatcgcctt

SEQ ID NO: 16446 - DNA, 557 bp, Zea mays
  Clone ID: LIB3279-230-Q6-N6-H12
tttgtttgtttttttttttttttaagaacgaacaataaatcaatagcagtagacccgtaagtccacaacgaacgaatgcgcatcgcagcattagcaatgtccactacaaagtatgtgaaactgttaatttatcatattcttgccgtgggcgtggggggctttatcatatccgatggagtaggaacctaggaggtcgaccccgatgaagccgggcctccgcacatcctcttctggaggtgctccaggctcaccacccgctgcagcgagtcagtgctgcccatcttgccggcgacctgagccccgttgacgaaatcgtcgtcctcttgagccgaggaagctatatctggcatgtaaccgtcgctgcctccgatctcgcttggaatggcgaagtaactgttcaggtcatcttggatgggtacggcggcatcagaggcggagtcggatggggagccattgaatggcatgctgagggacgacatatcagacacggcagggaacaatgtgttcatgccagttacccgcttcactgagtcctctgccatcttcacctttgctct

SEQ ID NO: 16447 - DNA, 470 bp, Zea mays
  Clone ID: LIB3279-230-Q6-N6-H2
acaaagacaaagccaaggggggaacgccccgggggttaggggccgggcaaattcgctaaaggaaacagaccaccccgaacttttgttgggcacaaccgggggggggcccaagggcaaaaaaatttggggggaaagacaggggggcccgggggaaaaatggggggcggggccaggggcccagggcccacaggggccattgggggagcaaaacttggaagcttacccccccgggtccttatttaccaaggggtcgggggggccaaacaaataaccggccaactgggggggggggccgaagggttaatttaccttttccttttcccaggcgaaccccctcccggggggggcttcccacctgacccgggtggttttgaccgggaaaaaggggcctttttcccgggggggccggccccattggttttaagggaaaggggcactgggattcctttttttttggcgctttgcagggc

SEQ ID NO: 16448 - DNA, 405 bp, Zea mays
  Clone ID: LIB3279-230-Q6-N6-H3
tcgcgatctagaacccgggagagggaaattgtcgacctgaactgtgaaggagtgcagactgagaccttagatgctctgctctctcttgccaagcaatgtgttagctcctcgccagaggagaggccgacaatgcacagggtggtacagatgctggagtcggatgtaattacaccgtgccctagcgacttctatgattcagagtagtctcctggacaagccacgctgctgctagtttcccgtgggggcgcattcctttattctttgcgtatattgtgtaaatgcattgccgcggtgtttggtctccaatcggctggctcaacgggtgacatttttttgcgtctgtatacctatgtatgtatctgtcatgctacaagttggctatatgctgatttaataagagagaac

SEQ ID NO: 16449 - DNA, 624 bp, Zea mays
  Clone ID: LIB3279-230-Q6-N6-H4
gcagccttaagatcatagatttactcgtttcagttgcatacagcatcagagtctaggaaaacgaacaaagggtcccacaattcaagcctaagggctcaacattgacaaatttattacgagaaagacaatacgacaatctgcttgttcacattgactccagatgcaaaagaccacatgcagcagaatgtatcactccaggatagggtctatttaagcatcagcaaaccccagttcggagagcttgaggtgggcctctttgtagtcatcaaagaaagccttctcatccgcagcatatttctcgacaagagggcggaaaacagggtcactcagcagggctttgtcacttgggagctgaagaaggccctccttatcaccactcagaagttccttgaagtaagagttgtcaaagaccaaagggtttgtagtccaggccccctcgaaaccagaccgctctttgtggcaccttcccaaggtgtggccaccagagagggcaacaatgtcctgatcgctcaagcccatctgcttgccaaaaacttgcctcaggtggtcagaacccttagtggcatcaggaaggcggccctcaggtgggggctgaggcttgtcctccctaccggggtggaaggg

SEQ ID NO: 16450 - DNA, 619 bp, Zea mays
  Clone ID: LIB3279-230-Q6-N6-H5
cagaaaccagtgacctgcattgaatttcatgtctgttccgtaaattgacaagatacaaacattattctatatatcatcgacggtgtaagaatcagaaagtacaggcctgacgctgatgcacattcatctacaaaccacaagagcatgttaatttctggtcaaatgggtcgttcgaaataagtccatctcccatagtctggcaactaaatgcatacaggacaacaataatcggaacaccgatcacacggtgtcatcatggaaccaccacctggtctctttcggagacctcccattgcgacagttcttgacatagcgatcattatcagctgggcgttgcttttctggcgagctggacagcatagataatatgctgatacagatagaactgacagtcatcgctggggaccacgagtcatacagtatatctaaacagatgtgtccattgctgtaaatgtgtggatgcatcggtgctggatgcagaaatataacctgaggtgcctccatcggataatgctcggggaaatccacctgcaacttgtaggtttcgccagtgtagagcgtgcctgctgcccccgctacatcgatgacccacctctggaggtcgtcggtgaccctgtgc

SEQ ID NO: 16451 - DNA, 564 bp, Zea mays
  Clone ID: LIB3279-230-Q6-N6-H6
acgacatccgatcaacaatcccgcatttagtacgatgcaaatttgccccctctacaactaaaacacaggtcatgaatcggattccagttttgcgcgagttccaagtgttccaacatttgggcttttattccaaacaacagctaaaagaaaatggccggcaaaactgcagcctcttatctaggctactactggtactggaggaacgagtaccaacatcagtgcttggcgctcacaagagccatgtgagcgatcagatccagaacccggttgctgtagccccactcgttgtcataccaagacacgagcttcatgaaggaagagctcagtccaataccagccttggcatcaaagatgcttgaccttgaatcaccaacaaaatcattggaaacaacatcctcgtctgtgtagccaagaatacctttgagtgcaccctctgatgccggcttgatggctgctttcacatcatcataggaggcgcttttctcaatccggcatgtcaaatccacaacagagacatttggtgttggaactcggaaggccataccagtgagttttccattcagc

SEQ ID NO: 16452 - DNA, 612 bp, Zea mays
  Clone ID: LIB3279-230-Q6-N6-H7
gattgcacttgcgcagccagtcatcatcaagatcaacaagccaaaggcaagaacaagtcggagatttcttacacggcatttcagaccacacggtcaaattcgttatcgaactttttacgttatatgtagtgtaccaatgggggggtgaggttctcgctagaagaaagaagagagatggcaaatgatgcttgcaacttggatgggacaccaaccgctccagaaacttcaatgttggaatcctgtgggttgcggcgatccgacacggccagctcctccttattcccgctgcctgtaataactttagccggcgagaagatggtgatatgtacaatggaccgggcacaaccttcggtatttacagggtgagagaggtaggtcagatggctgcgctcctcaatggtgggctgtcggacttgagaaaccggaaatactccttctgcaacatctgccctccgttcacttggtcgaagctgcacctgtagaagctgccatccaggccaaccatcatcacagtattctgagcaccaaaggctactatgtaacgggtgacttctggtaaatggaactgagcaaatgaccactctgaactgaatacttcggcaggatccctct

SEQ ID NO: 16453 - DNA, 545 bp, Zea mays
  Clone ID: LIB3279-230-Q6-N6-H8
agagaaccaaattcccatagctgttttatgtttatacatttacccagtttacaagggttgcgttggcccaaagctaagggctccccaagcccaaaaccaatttttccaggacactaacaacatcaagcttacagaaactggaaacaccacaacaggaccccggttttggggggggctggccaaaactaaacatagcacacgcaacaccggaccggatctttattttttaattgcatggggccagcataagggggcagccaaatccccataggtccttccttccttcctgaagctgaagcctgaagctcatcgggttggggaaaaataacctcccgagcccaaaacgggattattcgtgggcggcgtaagtattttttttttcacagtttatttatgggtaaggggcactgaacaatttcgggggggcagccacaggccctaagggagttcctgaaaccacgtacgggggtttatacacatgttcaaaatgttaaaatcgcaaacttgggccagtactggtaaaatttttgcctcgaatactcctt

SEQ ID NO: 16454 - DNA, 607 bp, Zea mays
  Clone ID: LIB3279-230-Q6-N6-H9
agggaaagtcaagcataacaacatttcagaacacatggtggacaaatgaagaaataaaggatgaaactatggaagttgatagaactatgactcagaagcctcgaattgcaacttacacctgatgagaaagcaccatgagagtatgccaaaccctacagctggcacaaaaatgcgttttaagttaaacatgtaggcaaaattagttcttgcaatctacctttccctagtaattataattcagacgatcatacttgggtgttggttttggttagaacattccctgaagtatctgatcattttttatcgtaactaaagtaactaattatggttcaactcatgcagtatgggttttgttttagataatttagatcatgaactacaatgcatagtggttcagtaggcataaaagatatatacagaaaaaaatgctctaacactatattgtttaagagagccattaattcatgagaaatgttgagttgttataaagttatatcatgaatggaagccttcctctcggataaaaattggttgcccgcaaatcagcttttatgcatagtcaaaattagtggaactacaagtcataaagtttgatacataatagtca

SEQ ID NO: 16455 - DNA, 647 bp, Zea mays
  unsure (1)..(647): unsure at all n locations; Clone ID: LIB3279-231-Q6-K6-A1
ggatggagtgcctggatattcctcacagcgagaagaggtttgctggattcaagaaggacgacaagcagttggatgctgatacccaccgcaggtacatctatggtggccatgttgctgactacatgaagaaccttgctgaagaggacccagaaaagtaccagagccacttcagtgcgtacattaagaagggagttgaggctgatgaaatagaagcgctgtacaagaaggtccatgctgccatccgtgccgatccttccattgttaagtcaaccaagcagccaccaaaggagcataagaggtacaaccccaagaagctgacatatgagcagaggaaggccagcctcattgaaaggctcaaccaactcaactcctccggtggtgctgatgacgacgatgaggacgacgagtaaagttaattgccatcgaagtagtgctatctcaatccagcgatcagcaattgtgtactgtcttatgcggggacctgtagtactgcaataggcatttttgttttaaagttttgcgaggtgaacaaaactgtttctgttagtttcgagcttgagctctcaatgtttactctntacattgaaatgctgtcgtttggacatgttttttctgagttctacacctgcttgtcttgcttatgtgac

SEQ ID NO: 16456 - DNA, 633 bp, Zea mays
  unsure (1)..(633): unsure at all n locations; Clone ID: LIB3279-231-Q6-K6-A10
cccacgcgtccgcggacgcgtgggcgggcgcgtgggcagctttgactgccctcgcttggtgctcagttcttccccctgctcctccgcctcttctcgcacctcggcgccttcttcggcaactgcgagcgagatggaggcgcaagacgactgcaagtggcggcagatcccggcgttcggcggctggaacgtgtgggacggcgacacgcccgtcacccagtacttccaggcaggggccttcttcttcgcggcgccggcggagaagggcgacgcggatctcttcaaggtgccccagttgcctgccaagccctacggctacaagaagtgcgttgttcgagtgaagggggagaaagaaaccgctgtgccggcggcggcgaggaagggacgcaggaggcgctgcgtgagcgagcagcacaagtggaagcccaagggagctgtggacgaggacctgtacaagatctccccgcagcttctctgcaaggtgaagaagaagaagctgctgaggaatttgcttggagggtgcctgggcttgggctgcattgcctgagagtgagagatgcagagcttaataagtttcttgaaagttcgcttgcttgatgctctggagagagttgtatagntgtctacgctaatatg

SEQ ID NO: 16457 - DNA, 641 bp, Zea mays
  Clone ID: LIB3279-231-Q6-K6-A11
cggacgcttgggcgagctctccaccagggtacggggaagaaagaaccaaccatgatcagcaccaagaggatcgctcagctggccaagaagtggcagaggatggaagcgctcgggaggaagcgccgcctcgcctgggggacggcggcggcaaagaaagccgacaggtgctgcgcctccggggggagcaagggccactgcgcggtgtacacgactgacggggcacggttcgaggtgccattggcgtgcctcgggacggcagtcttcgccgagctcctgcacatgtccagggaggagttcggcttcgcgggcggccacggcaggatcttgctgccctgcgatgccatggtcatggagtacgccctgtgcttgctgcggaggggcgcctctgcggacctggagaaggcgttcctcagcaccatggcgatgtcgtgccactctgcagaccacgcggcggcgccatatgtggcggcttgctgttagtttgcagctgtgtataagtagtggtacagagttcatcactgtatatagtaggacaaagagaggtgttgttcagatcctgcgacccattaagtagggtagcgaattagcaagttagccccagtgctcttggttgagcagtgagcatattacagcttaatttc

SEQ ID NO: 16458 - DNA, 329 bp, Zea mays
  Clone ID: LIB3279-231-Q6-K6-A2
gttctagttcgcgagtggccgaccttttttttttttttttttttttttttttttttttttttggaacaacaaaatggaactttctttccaagactggctgcttcatcaaggattcaaggtctactcagaatccacatccagacatcctgaagccttgtcgttcaacgatttactccagaaacacaaccggaaaaaaaatgtcattaacaatactattccaaagaccaagatcctcgctatcccttgctctcaaaagtatcgcactactcccatgctagtcgcgccctgagcctagccggaaccgacgataatgttgttgtctagatcgc

SEQ ID NO: 16459 - DNA, 665 bp, Zea mays
  unsure (1)..(665): unsure at all n locations; Clone ID: LIB3279-231-Q6-K6-A3
cgcccttggccccttctctctcttcgtcgcgccgccgtagcacgactccgactcggccatggcgacacccccagctctcctattcccttcgccctcttcggcatcttctccgccgtcatccgcgcaggtagaggcggtggtcctcttcaacgtctgcgacagctacgtgcggcgaccggaccaggcagaccgtgtcatcggcaccctccttggatccctcctccccgatggcaccgtccacgtccgcaactcctacgtggtcccccacagcgagtcggccgaccaggtcgccatcgacatcgactaccaccataacatgtacgcctcgcaccagaaggtgaaccccaaggaagtcatcgtcggatggttctcgactggatttggtgtttctgggggaagtacgcttatccatgagttctattcaagggaagtacaaagccccatccatcttacagtcgacaccggcttcactaggggggaagcttccatcaaagcctacgtctcatccaacctgtccctcggtgataggcaactcgctgcgcaatttcaggaaatccctctggatcttaggatgatcggngcagaaaaggctggatttgagatcctgaaatctacgatggtagagaagctccccaatgatctggaaggaatggagtcctcaatgg

SEQ ID NO: 16460 - DNA, 663 bp, Zea mays
  Clone ID: LIB3279-231-Q6-K6-A5
ggacaacaaagaacaactactaaccattttccatcctcaacatttggtaatggttccccagcaaggtatcagaacaagagcaccaccacaccgcagatgggtatgcagaatagaagacctacaactacatcaccagctcctacttatcccaataggatgtaccctagctcccgaccgtacacccagtatgggaattcaataaaaactggccttccctacgggagcaacggttatgattccaggatatatgggcgatggggtcttggtatggataacaggtacaggcctaggggccgtaatggatactatggttatggcaacgagagtcaggatggaacaatcgagttaaacagaggtcctagatctggccgtttcaagaaccagaaattgtacggccatactgtcactattgctgtgaaagggcagagccttccttctggtgaaagcaaggatgatagtgccgtgcctgatagagcacagttcaatagagacgatttccctgttcagtatgatgctgcaaagttctttgtcattaaatcgtacagtgaggatgacatccacaagagtgtaaaatacaatgtgtgggcaagcacaaccaatggaaacaagaagctcgatgctgcttatcaagaagctcagtcgaagggttctgcgtgccctata

SEQ ID NO: 16461 - DNA, 653 bp, Zea mays
  Clone ID: LIB3279-231-Q6-K6-A6
gctagccactagggtttgccagcctttgcagcgtcgcgctcgcgtctcatgcccttgcccatcgacggtagacgagagcgagcggtctgtgttcgtggagcaggggccggcgccatggagatcaacatcgtagacaagtacgagaagctggagaaggtcggggagggcacctacggcaaggtgtacaaggcgcaggacaaggcgacggggcagctggtggcgctgaagaagacccgcctcgagatggacgaggagggcatcccgcccacggcgctccgcgagatctccctcctcaacctcctctcccactccatctacatcgtccgcctcctcgccgtcgagcaggccgctaagaatggcaagcccgtcctctacctcgtcttcgagttcctcgacaccgatctcaagaagtacctcgacgtctaccgcagggggcccagcgccaggccgctccccgcgacactcatcaagaatttcctgtatcagttatgcaaaggagttgcacactgccatagccatggtgtccttcaccgggatttaaagccacaaaacctgctggtggacaaggagaagggtatactgaagattgctgatctgggactcggtagggctttcactgtgcccatgaaaagctacacccatgagattgtgac

SEQ ID NO: 16462 - DNA, 657 bp, Zea mays
  unsure (1)..(657): unsure at all n locations; Clone ID: LIB3279-231-Q6-K6-A7
cactcagaaaacccagccgccgccgcatcggcctcccaggtaagcagtagcgtccaccccagccgccgccatgaagcgcaacccccgcgtcacgagctcccccggaagtgccgcaaggcgcacttcacggccccgtcctccgtccgccgcgtgctcatgtccgcggcgctatcgacggagctccgccacaagtacaatgtgcgttccatcccgatccgcaaggacgacgaggtgcaggtcgtgcgcggcacctacaagggccgtgagggcaaagtggtgcaggtgtaccgccgtcgctgggtcatccacgttgagcggatcacccgcgagaaggtgaacggctccaccgtgaacgtgggcatccacccttccaaggtcatggttacaaagctgaagcttgacaaggaccgcaaggcgctcctcgaccgcaaggcccggggccgcgccgccgacaaggctaagggcaagtttactgccgacgacgtccccgccgctgctggtggcgccgccgccactggcgcgtctctccaggagatcgactaggcgcttcgcggggatctgatggtggtcctaccgnctattactccttatcgctctagttnttgctatcaatgattatgtgctaggagttntatgttacttataaactgctttgag

SEQ ID NO: 16463 - DNA, 665 bp, Zea mays
  Clone ID: LIB3279-231-Q6-K6-A8
cggacgcgtgggcgcggcgaccacccgattcgagagcgtgcggagagaccgaagaagcgggagagatggctcgtaccaagcagactgctcgcaagtccacgggagggaaggctcccaggaagcagcttgccaccaaggctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcagggaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctg

SEQ ID NO: 16464 - DNA, 615 bp, Zea mays
  Clone ID: LIB3279-231-Q6-K6-B1
aggagagtacgtggaggagcagccatggcttcatcggtggccgccgcggcgagcacattcctgggcacccgcctggcggacccggcgccacagaacgggcgcatcgtggcccggttcgggttcgggttgggcggcaaggcgaagcctgctccgaagaaggtggcgaagacatcgacctcctctgaccggccgctgtggttccccggcgccgtggcgcccgactacctggacggctcgctggtcggcgactacgggttcgacccgttcggtctcgggaagcccgtggagtacctgcagttcgagttggactcgctggaccagaacctggccaagaatgaggccggcggcatcatcggcacccggttcgagtcctccgaagtcaagtccaccccgttgcagccctacagcgaggtgttcggcctccagcggttccgcgagtgcgagctcatccacggccgctgggccatgctcgccaccctcggcgccctctccgtcgagtggctcaccggcgtcacctggcaggacgccggcaaggtggagctggtggacgggtcctcctacctgggccagccgctgccgttctccatctcgacgctcatctggatcgaggtgctc

SEQ ID NO: 16465 - DNA, 602 bp, Zea mays
  Clone ID: LIB3279-231-Q6-K6-B10
cccacgcgtccgatcgggatgagcttcgaccggcacttctataacttgggggtcggggcaatcgaggaaatccgtgttcaacaggataaggggtttggatttgtgagatatagcacccatggggaagcagcattagctattcagatggccaatggattggtagtccgtgggaaatcaattaagtgctcatggggaaacaagccaactccacctggcaccacctccaagcccctaccccctccagttgcttcataccagcctgctgtagcaatgtcaggtgtcccacaaggtttcacagcagccgaacttcttgcttaccagaggcagcttgccttaagccaggctgcagcagggcagattgctggccagcatggtctcgcgggtcaggtttctgcaggtcttcttgctgctgctggttctcaggccctctacgatggctacccgaaccagtcatcagcccagcagcttatgtactacaactagagttcaagaggacggcgttggccatcgtcgccctgttttttattttgtggttcatgtactatttgtgtgagagttcttgatctcttgtcgccgcggaattgggttactatcttattact

SEQ ID NO: 16466 - DNA, 649 bp, Zea mays
  unsure (1)..(649): unsure at all n locations; Clone ID: LIB3279-231-Q6-K6-B11
gttggttcaaagagacgtagaaaggaggttgtgtattcggactcttttggtgatcagtggatgaaatccgacgagggatttgaagagattgcaaagatgactccaagggtgaagcgaactgcttattcgcctgacattcaagttgagtacaatgaaaggaggaaaaggcccaagtctgtgggaaacagcgcagatggcgcaagcaacccaacacggacacccgacaaaggaagggctggagtttcatcatacagcaaggatgagaccgaagatgatggtgaagacgaagtcatcaccagtggcttacagaagggtaacagtttcacatggaagacccttggaagaaaaaggtcaagccacttaagttcgtcgtcggactcaaaagggcgaccaccattctaatgtcagttgccttgatgcttttgctcgatgaagcccttctaataatggagtacccctggaggctagcagcgctaccatttcgaaagtaccttgaacctataaacttcaggatggaggctgtagctagcaggactaccattntgaaagtacattgaagctataaacttcagaattagtaatttactctggacttgttgccatgaaattctaactcaaacgaactttaattgcgttacagttcaagcct

SEQ ID NO: 16467 - DNA, 617 bp, Zea mays
  Clone ID: LIB3279-231-Q6-K6-B2
tgcagcacgactctacacggtagacagacgcagagaagcatatgctacaatactgcattcagcaagtgaatatgtttgcggtgcgataacagcagctcaaagcattcgtcaagcaggatcaacaagagaccttgttattcttgttgatgacaccataagtgactaccaccgcaaggggctggaatctgctgggtggaaggttagaataatacagaggatccggaatcccaaagcggaacgtgatgcctacaacgaatggaactacagcaaattccggctgtggcagcttacagattacgacaaggttattttcattgatgctgatctgctcatcctgaggaacattgatttcttgtttgccatgccagaaatcaccgcaactgggaacaatgccacactcttcaactctggggtgatggtcattgaaccttcaaactgcacgttccagttactgatggagcacatcaacgagataacatcttacaacggtggtgaccaagggtacctgaacgagatattcacatggtggcaccggattccaaagcacatgaatttcttgaagcatttctgggagggtgatgaggaccaagtgaaggccaagaagactcggctggtcg

SEQ ID NO: 16468 - DNA, 668 bp, Zea mays
  unsure (1)..(668): unsure at all n locations; Clone ID: LIB3279-231-Q6-K6-B3
caacatctgttatggctattattgcacgcaaaggttctagtctggttagggaaatccgtgaaaagcaaagcatgaacaaatcaaggcaacgattttgggagcttgctggatctaagcttggcaatatcttgggtgttgagaaaacagctgaacaggttgatgcagatactgctgttgttggtgaccaaggtgagattaattttaaagaagaagcaaagttttcacaacatttgaaggataaagcagaagctgtcagtgattttgcaaaatcaaaatccctttctcaacaaaggcaatatcttcccatatttactgtccgggatgatctgctacaggttgtgcgtgaaaatcaagtggttgtggttgttggtgaaactggttctgggaagactactcaactgactcagtatctgcatgaggatggatatactaccacaggagttgttggttgtacccaaccaaggcgtgtggctgccatgagtgttgctaagcgagtcagcgaggaaatggagactgatctgggagataaagtcggatatgccatacggtttgaggatgtcactggtccaaacactataataaagtatatgacagatggagtgcttctccgngaaaccttgaaagatgctgacctcgacaaatatcgtgttgttgtcatggatgaagca

SEQ ID NO: 16469 - DNA, 563 bp, Zea mays
  Clone ID: LIB3279-231-Q6-K6-B4
cggacgcgtggggtcgaccggttcctcggagcacgatgaagtttgttgctgcctacctgcttgctgtcctcgctgggaacgccagcccctccgctgacgatttgactgccattctggagtcagttggctgtgaagttgacaatgaaaagatggaactcctgctgtcccaactgagcggtaaggacatcaccgagctcattgccgcgggcagggagaagtttgcttcagtcccatgtggtggcggcggtgtcgctgttgcggcagctgcacctgctgctggcggagctgcttctgcagctgaggcaaagaaagaagagaaggtggaagagaaggaagaaagcgatgatgatatgggcttcagcctcttcgactaggctgcacagtcatcacagtattgttttgggcagtgaaaccagaggaaaaccagagtcatgtttagattttaagcttgttttatgttggaaagtactggaaagactgctacttgtctttatatttggtaattcagccgtagattgctatgctggttgggatttactcgtgaaccagagtttttctgtctt

SEQ ID NO: 16470 - DNA, 652 bp, Zea mays
  Clone ID: LIB3279-231-Q6-K6-B5
cggacgcgtgggagcgcgccttcgccgccgcccccgcccccgccgcctctgcgatccccgcaaggtcgcaaacatgtctaccgtgctccagcgcccgacccccggcacggtccagtgcttcggccgcaagaagacggctgtggccgtcgcctacaccaagccggggcgcgggctgatcaaggtgaacggcgtcccgattgagctcatcaggccggagatgctccgcctcaaggccttcgagcccatcctgctggcggggcgctccaggttcaaggacatcgacatgaggatccgcgtccgaggcggcgggaagacgtcgcagatctacgccatccgccaggccgtcgccaaggggctcgtcgcctactaccagaagtacgtcgacgaggccgccaagaaggaggtcaaggacatcttcacccggtacgaccgcacccttctcgtcgccgaccccaggcgctgcgagccgaagaagttcggtggtcgtggcgcccgcgccaggttccagaagtcctaccgttgagcgctcggctgcccgctcttgccggacagttgcctgtgttgtcccaacttgccagatcgatgcctgtacccgtggcttaattttctatcatcggagctacttatggtggtctataactagattgctgtt

SEQ ID NO: 16471 - DNA, 663 bp, Zea mays
  Clone ID: LIB3279-231-Q6-K6-B6
cccacgcgtccgggatttggtctcctgacgggattggaggaccggactgctgcctcaacacctcgaccacatgcatcttcttgcagcacggtccacagtcaagctccatcaagaacatgatccacatgtcgcagcgtaagaatataatccttttatttattcttcttcgttaagaaatcagcgtacacaagaattaatctttatcaggaacgaaggaatctgttccccagttgctcgtgtaaaatacatcgatccatgtgtgtcatcgatcagtggtcaggaaagagacgatcaggaagtacgactacggaagcgagaaggagaacacgaagcgctacaaccagacgcggcccccaacctacaacctctcgtccatcccaagccacgtccccctgttcctcacccacggcggccaggacttcctcggcgacgtcgccgacaccaggcacctcctgcggacgctgctcagccagcacgacagcgacgacatcgaggtgctgtacatgcctgactacgcgcacggcgacttcatcatgggctacaacgccccgcagctcatatacaagcccatggtggagtttttcaagcgccactgagaagtgagaacttgctagtgcctagtaataactagtgcctagtaataagctgctgctgctatatgca

SEQ ID NO: 16472 - DNA, 603 bp, Zea mays
  Clone ID: LIB3279-231-Q6-K6-B7
cccacgcgtccgcccacgcgtccgcggacgcgtgggcggacgcgtgggctcgactccgccgccgctccgcctcagcgcgtcgcccgccgccacatgctacagcgacctcatcgatcaccttcaactttcaatcatggcggacgtcgatgtcgaaccggaggttgccgccggcgctcccaagaagaggacgttccgcaagtacagctaccgcggcgtcgacctagatgcgcttctcgacatgtccacggacgacctcgtccagctcttccccgcgcgcgccaggagaaggttccagaggggtctgaagaggaagcccatggcactcatcaagaagctgcgcaaggcgaaaaaggatgctcctgctggtgagaagccagagccagtcaagacacatctccgtaacatgatcattgtccctgagatgattggaagcattgttggggtctacaacggcaagacgttcaaccaggttgagatcaagcctgagatgatcggccactaccttgctgagttctccatctcctataagccggtcaagcatggcaggcccggtatcggtgccacccactcctcgcggtttattcctctgaaatgagctggtac

SEQ ID NO: 16473 - DNA, 398 bp, Zea mays
  Clone ID: LIB3279-231-Q6-K6-B8
gacagcttgaaggtttctggtgatgtctggtttggctctggaattacactcaagggcaaggtgacaattatcgccaagcctggagtgaagttggagattccagatggagacgtacttgagaacaaggatgtcaatggccctgaggatctttaagcaatgtttatcatcaccagttttcccaaggacatgtcacaggaactgccaagcctaatcactcctactgagctctatattttgtaattttcatgtgcattccgattccgctgtgagggtcatgtgagcccgctagagaataattgtaatcttctttgctgcgtctgtacttctgtttttgtgcgccaggacgtatatttttactgaaatgatactccgaagagcacgtatggtgtcttaccggg

SEQ ID NO: 16474 - DNA, 555 bp, Zea mays
  Clone ID: LIB3279-231-Q6-K6-B9
ggtgcctaaaaatcccaaggcaccgacccctgcggctattcacaggcactcctttcgcctcatagagagtaatcaccatggggagagaaggtagaagggagtagaggtctagggcgttgccgacgtcgtcttctgccatcacgtcatccagtgctcgtgtggaggtcctggggaaccaacgtgccgtaagggacctgggcgaacctctctcgtgcaaggattcggccgggctcgccgggaatttctcactgacgcaagccactgccgtggatcgagctctgctgtggccggagcgctacgcgacagaccctctggtgaagagcaggtggcctcggaggaacactactacgaggagtttgacgaggtctaggagtcatctcccagtcgacttaatggcgtcaaggaaataatattagttcattttatttttatcagttattttgtaagacattctcgttatgtaataatgtttgtgacatttatctctatacacttggtcattgtatgtgttcttcttctttggcacatatgagacgcacccgagtttaccccctt

SEQ ID NO: 16475 - DNA, 652 bp, Zea mays
  Clone ID: LIB3279-231-Q6-K6-C1
ctccagtttccatgcagagcagaaaagacagctagcgagagaagcaatggcgtcggctcctgcgttctgcgtcgcgctgctgctgctgctggcttccgccgctgccgtccaagcggtgccgccccaggccggcacgtcgtccacctgcagcactgacctcctccgcctcctcccctgcctgcccttcatcgagggcaccgccaccgtgccggcggacacctgttgcgccaacctgggcagcatggtgcacgacgagccgcagtgcctctgccaggctctcagcaaccccagcacggcccccgtcgccgtcaacatgacgcgcgtgatggccatgcctcggctctgccgcctcgacctcccgcccgccaccggcgcctgcgcagttgccggtcttcttccccatggaccatcaccgccgctgccaccgccgccgccgccaccggcggtcactccacacgcaagcgccaactccagtgctccagcgaccctcaccacgccagcgacgccaacgccgacgacaccacgtatgataccgtcaccatcggtgagcagtcagacgccgccgcgatacagccgggggtccaagaagatagctgacggcttctctgtcactcttggtttcgtggcatttgtggcagtcctagctttctga

SEQ ID NO: 16476 - DNA, 589 bp, Zea mays
  unsure (1)..(589): unsure at all n locations; Clone ID: LIB3279-231-Q6-K6-C10
cctccgaattcctcgatcgattcgtgtggaaaaaccccagcccctccccaccgccgccccccgtcggaatcccgaatccatccccgatggcgcaaggcaccgtgccctccgcagccggggccggcggcggcggctgcccctcggcccccgccgtctcgacgactcctccgggcacgccccgggctgccccgcctccgccatctaccttcccgaccggattctactacgccgtggagctctatttcgacccggcgctggagaaccaggtgctcaaagcgtggaacgcgctggcgcggcggcagctaggcagccgcctcatcgacgctgccgcccgcccgcacctcccgctgctccacctccccgccgccgcgctcccgcctcctggcaccggcgcgggcggggatccgctcctccgcctcgcaccctcgctccgcgcgctcgcgtcgcgcctcgacccgctcgcgctcgcgctctcctcgctcgccgcgctcccggccttcggcttctcttncccgcacgacaacgttctcttcctcgcgcccactccaaccggcgcgctgctcggcctncatgcgcagctctgcgagct

SEQ ID NO: 16477 - DNA, 589 bp, Zea mays
  Clone ID: LIB3279-231-Q6-K6-C11
gcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgc

SEQ ID NO: 16478 - DNA, 626 bp, Zea mays
  unsure (1)..(626): unsure at all n locations; Clone ID: LIB3279-231-Q6-K6-C2
cccacgcgtccgggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatccaggtgaatcaagcccagaagcagaggcgccgcacctaccgtgctcacgggcgcatcaatccctacatgtcctcaccttgccacattgagctgatcttgtcagagaaggaagagcctgtgaagaaagaggctgacaacattgncgcagcaaggaagcagggaagtatatcagcatgctgatcgaggccattttgtcgaagtattatag

SEQ ID NO: 16479 - DNA, 641 bp, Zea mays
  Clone ID: LIB3279-231-Q6-K6-C3
cccacgcgttcgcggacgcgtgggctagatcgcgagcgccgcccttttttttttttttttttttttttttagcccttatccaagatgagttaagaatatgaacggtcatttttttcaggcataaatataaatccgttctcttgccatggtatttagcacgcacaagcaacgcttgaataagtcttgcaaattcaacacaggttctacgaaagtggctttggctaaggaacgactgcaatgtcgagaaacgacactaagttctttcagcgcttcccaccaccgccgcccaacttggggcccttggaacccttctggaccgcaccctttgtctgcgtcttctgggacttgctcacctccgccttcttcgctttcttctcatccttggtcttcttgatgcgctccttgatctcacgaagagcagcttctctagcagcatcgcggacctctggcttctcagctctcttcttctggattacttccaaggaagcacccacaattgacctggagtatggcttcttggtggcgcggcgcctcttctttactgcttcagcatggatatccttcttgggctgcttcctgtacattgctgtccaggtaagcttttgaggtttcaggcggttgtggaagtaacgcttgcattt

SEQ ID NO: 16480 - DNA, 604 bp, Zea mays
  Clone ID: LIB3279-231-Q6-K6-C4
gtggccgccacctcatcacaggcgcccaccacttaccaggccaccacaaaacgcaacgcatcgcgacggctccccaaccccaacaagtctctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaacaactggcgagaagagtttctaattcaggctagcccatcagatcctgataatttcccttttgttctgttgggtaacaaagttgatgtagatggtggcaacagccgcgtggtatctgagaaaaggc

SEQ ID NO: 16481 - DNA, 590 bp, Zea mays
  unsure (1)..(590): unsure at all n locations; Clone ID: LIB3279-231-Q6-K6-C5
ccaagatcaagacaacgtgaagtcgtacggagtgtagcgcttccacatagtaccacccgctatctaaaggaggatgggtaatccaacgagctataaaatggggtcagattcattttcaactcattctttttctcgatcttttgactaagttaaagtgtaatatttattcttaccggttgttggggcgaaggcgaagacgctacccttcgctcgatgccttcgccaatctcgctgcaccaacggaggcaagacgactggcagtctccacccttcgtccaacacgtcgcaggacgaaggcctacgacgaggtcgccccatcccgcggcctcgtccaacacgaaggcccacatgtgatttggcccattgtaacaggccccgtgtggccgctgtgcattacaggcctaatttgtaaagacttctctgtaattacagtctataaccctactttatgggaatattccggggataacctgngcgcgtgagggcacatgcgtccttaatccaagacgctgggcatccaggcacctataaatacccccgcacagtgcccttgggaggcgagattaacagagcaattgccttcttgagct

SEQ ID NO: 16482 - DNA, 579 bp, Zea mays
  Clone ID: LIB3279-231-Q6-K6-C6
cgaaggttgaggctctgaggagccgtgccgacgaggagaagatcaaatacgagaagagcatcggggtcaccagagcaatgaccctgaataacctgcagactggcttccctaacgttttccaggcgatgacgggcttcgccagcgtgtgcatggaggcatttgagtcggtgtacaacttcaagcggagctcggacccgaagaggctgctgacctgaagcaatgttgtataaaatgtatacagtcctaggtttttagtaacaatgataccttgcaacctttgtctggctgttatcaggttctaatggcgcaaaaaaaaaaaaaaccccgtcaagttcaattacaccaagtaattgaaacttgaggccttgttttcctttttggttgagataatctcttgcctcggatgcaggttccaaaaggctcagctttgttttttcaatcggaagaaggtttgaactgtttgtttgcttccagcagctaatgacctgttgtttgtagcttcatgtcacgagctgagacttggatgggactggtaactgtagtctgtgcaattcagaaatgggccacacctgttgtttt

SEQ ID NO: 16483 - DNA, 524 bp, Zea mays
  Clone ID: LIB3279-231-Q6-K6-C7
aagcctaaagcatttccattatagaatgtcaactgaaggtccagctagaaaaaattacaagaaagaatgcgcatttctgccatttcatggggatcttgcctagggagcacaagtggtgtctctgttccctgtgcggcgagcagtccccatttttggttctgaagatcagcggtctgttcggttcatcaggattgagcaccagagtcattccagcttataaagatccaaccgtgaattattccaggcgctcattccggaggaaccgaacgagccttaaagaagctggcgaccccgcatccatgcatcctaggcgcaaaggatgaacttgccggagggcaaggccgcggcggcgacggcgagcaggcaggctgtgacgactttctgccggaaccaccggagcggcgcccacaggcccgcgcccttcacgctggcgcacttggccctcgtcaccccgtactgcggctccttggacaggtcgaacgcggcgcccttcaagcgcagctcctgcacggcccgcgcgagtg

SEQ ID NO: 16484 - DNA, 661 bp, Zea mays
  Clone ID: LIB3279-231-Q6-K6-C8
ccgtccggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtg

SEQ ID NO: 16485 - DNA, 645 bp, Zea mays
  Clone ID: LIB3279-231-Q6-K6-C9
gacagtggtcctgttacaagcgttagctgggctcctgatggtcggcacatggccgtcgggctcaactcgtctgacgtccagctctgggacaccagctccaaccgactgttgagaacactcagaggtgcgcatgaggcaagggtaggctcgctggcatggaacaacagcgtcttgaccaccggttgcatggacggcaagatcgtgaacaatgacgtaaggattagagaccacgtcgtgcagaggtacgaggggcacagccaggaggtctgcgggctcaagtggtctggatcagggcagcagctggccagcggaggcaacgacaaccttctgcacatttgggatgtgtcgatggcatcatccatgccatctgctggccgcaaccagtggctgcataggctcgaggaccacatggccgccgtgaaggcactcgcgtggtgcccgttccagagcaacttgctggccaccggcggcggtggcagcgaccgctgcatcaagttctggaacacgcacaccggtgtgtgcctgaactcggttgataccggatcgcaggtgtgcgctctgctgtggaacaagaacgagagggagctgctgagctcacatggattcacacagaaccaactcaccttgtggaagtacccatcgatg

SEQ ID NO: 16486 - DNA, 550 bp, Zea mays
  Clone ID: LIB3279-231-Q6-K6-D1
gagcaaccaaccaaccacctcctccccccctctccgtctccctgtccgcctgtccagtcccgacctcgctcgccactcggagtcaaccgcctgcgcctcgatccggacagcccagcccagcccatggcctccggcgccgtaccaccgcagcgcgtcgccctgctggcgctcgccgccgtcctctccgtcgtctcattcccgcacctgtccctccccgcatcgtcccatccgctcccgcaggaagctgctgctgctgcgcggggtgcggcggcgggaggcgaggcgtccgagcctcacggcaccgccgtggcgcggcgcgcgtgcacgtacacggtgcagatcaagacgagctgcgcgtccccgcggagctccgcggacgcggtgagcctcgcgttcggggacgcgtaccgcaacgaggtgtacgcggcgacggtgacgccgcggcgcgggttcgagcgctgcgccacggacacgttccgcgtcgccgggccctgcggctacggcgtctgctacctctacctgcgccggtcgggccgcgcggccgggtgga

SEQ ID NO: 16487 - DNA, 560 bp, Zea mays
  Clone ID: LIB3279-231-Q6-K6-D10
catttacagcatccttttcgggtcaaggtggatcaattccaggttttcatcattctggcttgcataacactcatggaagttacaatcttccgagtatgcctggatcacttgcacaaaggaatgctgccatgagtggccttccgtcctctggggttcaacaacctggaggtagcattcctgggagattcccttcaaacaaccttccagttggcatgcctcagattcctcatgcacattcaggtgtcagtggtagagggatgaattttggcgcaggtccggcatttagtagcagcatgaatattggtggtaacatccaaggcttatcctcgggcttgggctccggtggtaatcgcaattctgttcatgggatgccagtatcttcatctataggaaactcgggtcaacggataagttctgtaggaaatatggtaagtgcaagcaatattggaagaaatataggcactggtggtttgtccgtgccaagtattgcatcacgaatcaatttgaatggtagtggtgggagtggtagtctgaatgtgcaaggatccagtcgaatgatg

SEQ ID NO: 16488 - DNA, 622 bp, Zea mays
  Clone ID: LIB3279-231-Q6-K6-D11
gcagtgcaggtcctgctggtgaggacatgtttgattggcaagcaacaattatgggaccacctgacagtccctatgctggtggtgttttcttagtgaacattcatttcccgccagattaccccttcaaacctccaaaggtttctttcaagacaaaggtcttccatcctaatatcaacagggggggaagtatatgccttgacattctcaaagagcagtggagccctgctttgacaatttctaaggtcctgctctccatctgctccctgctgaccgaccccaacccggacgaccctcttgtcccggagattgcccacatgtacaagacggaccggccgaagtacgagtcgacggcccgcagctggacgcagaagtacgcgatgggctgacgaacgctttcctgctcgtctgggcgccattgttcccttggatttgttgttggtcgtatgtatccctgatccatctaggatcatcgtattgtattgtagtgtatgtatgtcgtcggcctaccatcgttgccatccaccatagtgaggtggttggacatgcttcgcctatatgcacctgtgcttgccttccttcgggtcggtgctgtttggttaatgttcatcgaagacgttgattt

SEQ ID NO: 16489 - DNA, 309 bp, Zea mays
  Clone ID: LIB3279-231-Q6-K6-D2
ccgcggaggccgccaagctcgcccggtacaacaagaagcccaccatcacctcccgcgagatccagacctccgtccgcctcgtcctccccttcgagctcgccaagcacgccgtctcggagggtaccaaggccgtcaccaagttcacctcgtcttagcccccttgtagtaggcgtcgttgttgtctgcttctcaagcaagcactgtgatgtgccgcttctcatggtagtagtggtggttggctggtgtgtgtaagtggtgcagtggcttttgcctgtgttatgaatttagtcatggtggtaatgcattgct

SEQ ID NO: 16490 - DNA, 651 bp, Zea mays
  Clone ID: LIB3279-231-Q6-K6-D3
cgtcaacgtgctcaagctcatccagcttggcctcaccctctccaacggggcaggcgcgctcccgccgtgcggcacgggtgggaggcgctgcatctggcagtttaacttccggggcttcgacccgcacaccgacccttctagcagcgactccatcgatctgctccgccgcagcggcatcgacttcgacctctttgcggctgagggggtcgattccacccgcttcgccgagctgatgatgtcgtccggagtcgtgctgaacgacgatgtccagtgggtgaccttccacagtggccacgacttcggctacctcctcaagctgctcaccggacgggaaatgcccaacaccttggatgagttcctgaaactcaccaagaccttctttccggtgatgtacgacatcaagcatctcatgaagttctgtggcggtggcctatatggcgggctgagcaagcttggggagctgctcaagattgagcgtgttgggatcagccaccaggctggatctgattcgctgctgaccctgcagtgcttcatgaagctcaagcagttgtatttaaaggagtctgttaagttgtatgatggtgtgttgtttgggcttattcctggggaagtggagatcaaacctgttgctccacccattgaatgagttat

SEQ ID NO: 16491 - DNA, 568 bp, Zea mays
  Clone ID: LIB3279-231-Q6-K6-D4
gatctggggcacaataataatgagaaagaagtatgttgcaaaagattacttcttttctgtcgtcgtgactatgggttgcgcattgttcattctatatccggcatcgatggatgtgagtccatttaataaaggcagagaaagcactatttggggtgtttcactcatgctcggttatcttggttttgatgggttcacaagcacgttccaagataaactcttcaaagggtatgacatggaaatacacaaccaaatattctacacaacagtctgctcttgtcttcttagtttaagcgggctgattctccagaatcatctgattccagctgtggattttatgttccgtcacccagattgcttctccgatgttgtaatcctctccagcgttgcaacagcgagtcagttcttcatatcctacaccattcggacatttggcgctctcacatttgctaccataatgacaactagacagcttgtgagcatattgctgtcctgcatctggtttgtacatcctctcagctggatgcagtgggttggcgcggccattgtggtcgtagccctatacacaaag

SEQ ID NO: 16492 - DNA, 650 bp, Zea mays
  Clone ID: LIB3279-231-Q6-K6-D5
cccacgcgtccgcccacgcgtccgcggacgcgtggggctctacccgcgacgaagcatcaccaggaaggatgacgggctcaatggatctcccggccaagggcgggttcagcttcgacctgtgccgccgcaacagtatgctggagaagaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcgcagctacagctgcaccgttacgcaacgggtcgcgaatctagagtcgtaactgctcttacactgctgaagtcacatctctttaggtatcaaggccatgtcagtgctgcccttgttcttggtggagtggattgtactggaccgcatcttcacactgtttatccacacggctccactgatactcttccttttgccacgatgggttctggatcccttgctgcaatgtcagtgtttgaatcgaagtataaagagggcctcactaaggaagagggaatacacctggtgtca

SEQ ID NO: 16493 - DNA, 636 bp, Zea mays
  Clone ID: LIB3279-231-Q6-K6-D6
cggacgcgtgggctggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagattgtgaaggaagtctcatcctacctcaagaaagttgggtacaaccctgataagattgccttcgttcccatttctggttttgagggcgacaacatgattgagaggtccaccaaccttgactggtacaaaggcccaaccctgcttgaggctcttgaccagatcaccgagcccaagaggccttcggacaagcccctgcgtctgcccctccaggatgtgtacaagattggtggtattggaactgtaccggttggtcgtgtggagactggtgtcatcaagcctggtatggtagtcacctttggtccaactggcctgactactgaggtgaagtctgttgagatgcaccatgaggcgcttcaggaggctcttccgggcgacaatgttggcttcaacgtgaagaacgttgctgtcaaggatctcaagcgtgggt

SEQ ID NO: 16494 - DNA, 595 bp, Zea mays
  unsure (1)..(595): unsure at all n locations; Clone ID: LIB3279-231-Q6-K6-D7
cccgcgtccggaaacaatcaaccagcaacactcttctcttataacatagtacagcgaaggtaactcacatggcaacttccatgggttgtctcgtcttgctctgccttgtttcttctctccttcccagtgccgtccttggccacccatggggtggcttgttcccacagttctatgaccattcgtgccccaaggcgaaggagattgtgcagtccattgtggcacaggctgtggccaaggagaccaggatggcggcatctttagtcagactgcatttccatgactgctttgtcaagggctgcgatgcttcggtgctgttggacaacagcagcagcatagttagtgagaaagggtccaacccgaacaggaactccctcagggggtttgaggtgatcgaccagattaaggctgctcttgaggctgcctgcccaggcacagtctcctgtgccgacattgttgcccttgcggctcgtgattccaccgccctggttggtggaccatactgggacgtgccacttggccggagagactcgctcggtgcaagcatcccaggctccaacaatgacatnccagcccccaacaacacactccccactat

SEQ ID NO: 16495 - DNA, 593 bp, Zea mays
  Clone ID: LIB3279-231-Q6-K6-D8
gaagagaaaggacaggataaccgcaaaggcgccgtaccaagtcaacagttccgtcggcgctgaggcgtccaaggcggagaaaccctggctgggtctgggccaggaacaggaaggaagcgacggtcgtcaagcaggagaggagatgtgatcgatcagtagagactagattcgttcgtgcgcgcgtcgtcgtagcttcaggttaagggaaagaataatccaaccgtcggttaattgctcggcttaattacactgctctactacgtagtactggcactgctaccaccaccaccaccaccaccagagtgaccaagttaagctagggattgttacataggccggccggtcggccgttcgttcgcgagattgtttcgctgctggagatgcgcatgcacgctcgcagcagcttcgctggtccgcgtggccgcgtcttgtgttcgcgcaacgaacggtgcacgttccggtacgttttcatttgtctccgacctgtcctgtgtgtgtgtgcgtgtgtttttgcactggatattcctcctcccctctcgtggtcgtagggagggtttgtatgttcagtggaaagatgtttggtatggtctact

SEQ ID NO: 16496 - DNA, 602 bp, Zea mays
  Clone ID: LIB3279-231-Q6-K6-D9
cggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgt

SEQ ID NO: 16497 - DNA, 563 bp, Zea mays
  Clone ID: LIB3279-231-Q6-K6-E1
gagatgacaagcagttctttgtggatcatcctggtgctgttcctatcactactgctcagggagaggagctaagaaagcaaataggcgcgccatactacatcgagtgcagctcaaagacccaactaaacgtgaagggtgtcttcgatgcggcgataaaggttgtgctgcagccgcctaaggcgaagaagaagaaaaaggcgcagaggggggcgtgctccattttgtgatctaataatgatcagtagacaaaagaaacaagggcgaaggtgccatggttctattatcgccgcgtcttgcttcagcgaaacagcaatggatgatcccaccccctcccccctagattttactggcggctgcagcgagtcgaggcattcgagagcgatatgtttgtttcattgccctccttcccgccttgtgattatctggtgtgtgtgtgtgactgacgaggtcgtggcaatttaggtaactcgcttagaaggtatttcccccgtgtttgagccccccacccaaaaaaaaagaaggtatcatgctatctctgttccataagtagacatgatgtaatc

SEQ ID NO: 16498 - DNA, 650 bp, Zea mays
  unsure (1)..(650): unsure at all n locations; Clone ID: LIB3279-231-Q6-K6-E10
caaaaggttcggtgcaatctagctctaaggatttcaagactaaaaagatatttgttggtgggcttccgtcaacactaacagaagacgaattcaagagtttctttgcaagatatgggactgtggtggaccaccagattatgtttgatcatgaaaccaaacgttcccgaggctttggatttatagtttttgcttctgagcaagttgtagatgatttgttagcaaatggaaatatggttgaccttgctggttcaaaggtggagatcaagaaagcagaaccaaagaaatcctccaatgcaccgccaccaccagtgcatgttagaaatgctaggtcagcatatgatagcggctctagagaccacccttcagctgacaactatggtggaatggccagtgcttatggaaactacaggggtggtggatttggtccttataggagcgatacaggatttggtgctaggctcagcagctatggtggggtaggtgattttggtggtgcatatggtcgttactatgcaggattaggagggggatatggagccgcgtcttcgtttggttatcctggtcgctttgggttatatggaggaggttntggtggatcttatgctggtgctgacttaagtggctatagacgtggtggaggtgatgagagc

SEQ ID NO: 16499 - DNA, 663 bp, Zea mays
  Clone ID: LIB3279-231-Q6-K6-E11
cgcccgcgacccaaaagccgaaagcccgagaaccagaggcgggtagggttctagctgcaggcgacggccatggccgcctccgccgccgccccggcgctgcttcgacgcctcttctgcagctctattccagcctcctcctccgtactgcgcgctaccttttgctcctccgccggcttcgggtgggcttctccgtcctccatattcggcgacgccaccgaggtcgccaacgtgccaccgctcaccacgcccaacctcttcgtcagtggcctttcaaggttaacgacagatgagaagctccagggtgcatttgctcctttcgggaggctccttgaagcaaaagtggtgacggatagagtttctgggaggtcaaagggtttcggtttcgtgagatatgccaccatagaagaggccgagagagcgcggcaggagatgaacgccaagttcctggatggatgggtcatcttcgttgaccctgccaagccaaggcagccaaagcccgctcctcagcaggacactggttcatcgcatgctggcttcacgacgaacaagactgtaggatggtgcggctaggctcattgatctgtcgcgatatttcacggcacaaaacttggattgcaggggtggatctaggggtgttcgtcacccggataaaattataaattc

SEQ ID NO: 16500 - DNA, 427 bp, Zea mays
  Clone ID: LIB3279-231-Q6-K6-E2
ggcctctgtcgtcaggcaaatgaaagattcagaaatggcgatgcagtggacgctgatatatcagctaaccagtaggctccgtgttctcttccagtctactccatccaataggcttctcttcgagtattcagcaacatcacaggaatgattcattttttgttattgcgcacagcaagaattggttgtagcagctgcgtcgtacaaagattaggtggcctgataatcgttttttttgtagataagcaagctttgataagttgtacgtgtacaatcgctcagttgtattgtatttacattctttctcggaaacaaagtttctgggcctgtaaataataggtagcgatcttagcgtcgggtgtagagagaagtataaatgaatgaacgtttcctgtctcttgcgttgctgtccatacgtgaaattggcttt

SEQ ID NO: 16501 - DNA, 666 bp, Zea mays
  unsure (1)..(666): unsure at all n locations; Clone ID: LIB3279-231-Q6-K6-E3
agaagaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgacctccggcttcagcctggatgaccccaacaccttcggcaaccggatccaccgcatgctcaaactcggtctgagcatcgatgaggacgagcctgttgaggcagaggctgagatgcctcagcttgaggacgacgctggtgaaagcaagatggaggaggtcgactaagtgtcgcatcgcatgcttgccgtttatcttatccctagctaagctacctgtgatagcttaattntcactattgttcgaggtttttggcacgttatcggttgtcctgctggccaggctataagtctggtttatctgttatgtttaccctttttaacag

SEQ ID NO: 16502 - DNA, 616 bp, Zea mays
  Clone ID: LIB3279-231-Q6-K6-E4
cggatccaaaaccctagcccctcggcgttttccccttcccggcgacggcgaggcggcggagctgctgcggcagcagcagcagcttccacctccgccgcagcacccgccgccccaagcctcctccgccggcggcggcggcggcggcgagttctaccgcggcccgccgatgcggcagctgtccgcggcgtcctccaccaatctcccgcccgactacgccgcacacccggcccccccgtcacagcagcagcatcagcctccttacgacgcttatggtgacagttttggtgctaaaaggatgcggaagcctgtccagcgacgaacagtggactacacaagcagtgttgtccgttatgttcaggctcgcatgtggcaacgggacgctagggatagattcacattgcagccaactccagcagctgtcctggatatgttaccgtctgtcgcatatccagacaacccctcaacaagttttgctgccaaatttgtacattcatcaatcaataagaaccggtgctctattaatcgtgtcttgtggacccctacaggccgtcgacttatcactggatcacaaagtggtgaatttacgctatggaatgggcaatcttttaactttgaa

SEQ ID NO: 16503 - DNA, 406 bp, Zea mays
  Clone ID: LIB3279-231-Q6-K6-E5
ggaaggctcctcggcgatgaacgctgggcgttcaagctggggagttgaagcaggtcgatgatggcattgaccgtgtaagcagctgtagtgagatgctcagggttgttagtgccagttcgctgctaatctgttgttttgtttgagatttgaggtcactaatgttattagactcatgacctgtatggcggttgtttctggactttcttttcttctttctcttaatttgagatttgagatgtctttcgtgtctattatttgaaccagttggtttgtgacgtctcccggtttggcaagttatgttttgtctgtatataatcggacagtaagcctaaaataggatccagctgcttggatttggatggtaatggttgtgaataatgcgctaccttttgcattgcagtaactg

SEQ ID NO: 16504 - DNA, 438 bp, Zea mays
  Clone ID: LIB3279-231-Q6-K6-E6
agaagatgttcggcaccttcaccgcatctgggaacagcatgaacgaggggagattggttgatccggccagcgacgctgatgatgtggtcactacttacgaagacaaggatggtgactggatgctggtcggcgacgtcccgtgggagatgtttgtcgagtcatgcaagcgtctgaggatcatgaagagttctgaagccataggtcttgcaccaagaacgaaggacaagtgcaagaacaagagctgaagaagatgcagtgttaaagatgttgcccattgtatcagaagaatggtccccttgcagtgcgctgccgttttttttttcctactagaaatataacgcgttttaattactagttggagggagacctgtcttgttcaactcgttcatggaccagaagcaataatatatccgtgtgtagctggattggtgttatgtc

SEQ ID NO: 16505 - DNA, 667 bp, Zea mays
  unsure (1)..(667): unsure at all n locations; Clone ID: LIB3279-231-Q6-K6-E7
cggacgcgtgggcagctccccacctccaccctcgccgcgagttgctcagtcgcagactcgcagcgagcgaggcgggggcctcactcagcgcggggcgaggcgagcgtcccgggtgggcagcgtcgcggtcgcgggctcgatcgggttgggacggggaggtagggaggaggggccagggatctccactctcgtccgtgcgggagcgcgggcgtcgcatgcggcggcgcgccggggcaaatgctggtagcctcacgggcggaggagcgctcacgctgaggcggcggccggggagcgatgcaggcgccggagcagcagcagcagcagcagcagcggaggaagggttcgtcagagatggacttcttcagtgaatacggcgatgcgaacagatacaaaatccaagaggtcattggcaaaggaagttatggcgttgtttgctcagctgttgaccaacataccggtgacaaggtggcaatcaagaaaatacacaatatctttgagcacttatctgatgctgcccggatcctacgtgagatcaaactgcttcggctattacgccatcctgatatagttgagatcaagcatataatgctgcctccatcaaggagggacttcaaagatatctatgttgtatttgagctgatggatacagacctncaccaagtcatca

SEQ ID NO: 16506 - DNA, 671 bp, Zea mays
  unsure (1)..(671): unsure at all n locations; Clone ID: LIB3279-231-Q6-K6-E8
cgaacactttgtgggttccaatttgttcttacacatctggacaacaggcaacttctcatcaaatcagaccctggtgaagttgttaaacctgaccaattcaaggcgattaacgatgaggggatgccaatttaccagaggcctttcatgaaggggaagctgtacatccatttcacggtggagttccctgactcgctggcaccagagcagtgcaaagctctcgagacagtacttccaccaaggccttcatccaagctgacagacatggagatagatgaatgcgaggagacgactatgcatgatgtgaacaacatcgaggaagagatgcgcaggaagcaagctcacgctgcccaggaggcgtacgaggaggacgacgagatgccgggcggagcccagagagtgcagtgcgcgcaacagtaagcagactatcatcaaggcaattgggaggggtggtgcccttaaagcgtgggagtgatctctggttttgctgtcgccgagctgggaaataggaagctgaatcgacctcttaagcggngaatgtatccttttttgctgcaacataaaaaatgctacccaggcatagctgggtaccttttaacttctgtttggggatttgctagagtgatggtttcgatatatagggggacttgaatgtctgtggaatgctacggtat

SEQ ID NO: 16507 - DNA, 633 bp, Zea mays
  Clone ID: LIB3279-231-Q6-K6-E9
cgtcattattaaaaaaaaaaaaaaaagggggaaaggaaaaaaaaaaaaaaaaaaaaaaaaaaaaaaaaaaaaaaaaaaaataaaaaaaaaaaaaaaggggcgggccgttttgggggttccaggtttccttcgcgggggcttccccacgtgtgggttcttttttagggcccccttatttcattcccgggggggtttttttccaccgtcgttgactgggaaacccctggggttccccaccttattcgccttggggcccttccccttttcccccgctggtttattggggaaggggccccccctgttcccccttcccaacatttgcccagcctgattggcgattggccccccccttgtggcggccctttaaccgcggggggtgtggtgttttcccccagtttttccgttccctttgccagggcctttccccccgctctttccgtttttttcctttcctttttggccccgtttttccggttttcccctgaatttttttattggggggttccttttagggtcccgttttggtgttttccgggccctctcccccagaatccttgtttagggtgtgggttcacgtagggggccatcgccttgttggacggtttttcaccttttgacgtcgcctcccctttt

SEQ ID NO: 16508 - DNA, 584 bp, Zea mays
  Clone ID: LIB3279-231-Q6-K6-F10
ctgctataaaaccctccgcctccaccggcggctcgccaaactccgtttcgaattctagggttttgctgctctccgaccccgagctccgaaggccgcagcatcaggcgaggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaagcaggtcaaagccaagcagggtactttccacaggaagaagaatctgcagtactatgaa

SEQ ID NO: 16509 - DNA, 194 bp, Zea mays
  Clone ID: LIB3279-231-Q6-K6-F11
tggtgaagtttttgcctttcatatcgaagaaattaataattcatgtagagggaggattcttccaacaatttgttttggatggagacttagatctccaaacactcgtaactatcctactaggtggtgacatcggtccccaaaaacatttatggtcatagagtctgcccttcgtttgtcaggcgggcaatttttct

SEQ ID NO: 16510 - DNA, 600 bp, Zea mays
  unsure (1)..(600): unsure at all n locations; Clone ID: LIB3279-231-Q6-K6-F2
cgccagtagagatgagggccacgtcgtcccccgtggctgccgccgtcctcgccgccccttccgccgccgccgccgtagtcgtaaagcctctgcctcgtggcgcagcgaatggcggcagcacgggcaggcgcgacgtgcttgccgggaccgggctgggcgcggcgctgctgctggcgctggggcccgtgtgcggcgcggcgcgtgcggcggacgaggaatacgtgagcgagacgaaggaggtgatcgggaaggtgcggtcgacgatcaacctggacaagtcggacccgagcgtggcggacgcggtggcggagctccgggagctgtccaactcgtgggtggccaagtaccggcgggagaagtcgctgctggggcggccgtcgttccgggagatgtactcggcgctcaacgccgtgtcgggccattacatcagcttcggccccacggcgcccatcccggccaagcgccgcgcgcgcattctcgaggagatggacaccgncgagaaggcgctccttcgcggcaggtaggccaaatcccagcgaagcccggccatggcgatcggcgtcgccgtggtggcaggaacgcagctcttagcgacaacgc

SEQ ID NO: 16511 - DNA, 619 bp, Zea mays
  Clone ID: LIB3279-231-Q6-K6-F3
cgcccctgtaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcaggagggtggcggcgacgacgacgacgatgacgatgatgagaacggggatgacgaggacgacgacaatggggatgacgatgaggagggtgtagatgaagaagatgatgaccaggacgaggatgaggaggaagatgatgatgaagactcgctccagcccccaaagaagaggaagaagtgaagatcttctgcggctttagttaccgtgcgctgagttctgcctggcttttcgtcatatcctcgcatttcaactttcccatagagagttaagaaggatccacacgttcagcagcacctgtgggc

SEQ ID NO: 16512 - DNA, 342 bp, Zea mays
  Clone ID: LIB3279-231-Q6-K6-F4
gctgactggccgcatgacaacaggccgtgttctttctcggtctatgcacccagcagaacagccgtcgtatatgcacctgcaggtgcagaggacgaatagggcacagcagcggttgttggggaagaacttcagagggatgtactgctggtggactgacaccactgccacgcgcgatgctgccagatgttgccctcgagaccacgtggcaggacgatcagctattcaggtggataggttagcttaccgatgagctctctcgctttcgagtgactggtgaaggaaatggacctcgcacaccgcattttcactatgcaatctgaaaatgtaccgtgtggtttttgt

SEQ ID NO: 16513 - DNA, 650 bp, Zea mays
  Clone ID: LIB3279-231-Q6-K6-F5
ctccgcctccgcgatcgaagctcctcacaaaccgttatcgtcgccatggcagccgccgcgcctgcaagctccgtgaaggaagtgctgccatctcccctgacctccgcctccgagccccctcccctcttcgatggcaccaccaggctgtacgttgcctatcattgcccgtacgcgcagcgcgcttggattgccaggaactacaagggtttgcaggacaagattaagatagtcgccatcgatcttgctgacaggccaacatggtacaaggagaaggtttatccagaaaacaaggtgccttctctggagcacaacaaccaggtgaaaggtgagagtttggatctggtcaagtacattgacagcaactttgaaggcccatcgttgctcccagaggatccttcaaaaaagcagttcgctgaggagctgcttgcatatactgatgcatttaacaaagcattatacttttgtatagtctccaaggaagatgtgtctgaggaagctgtcgctgctttggataaaatagaagacgccctcgggaaattcaacgagggtccattctcccttggtcagttcagtctggtggacattgcgtatgtaccattcatcgagaggtttcagatattctattccaacataaagaactatgatattac

SEQ ID NO: 16514 - DNA, 651 bp, Zea mays
  Clone ID: LIB3279-231-Q6-K6-F6
atcataaacgacacgattctagcgataaagccaaattgaattaccaaaagagtgatactgatggtaaagacattgatcatgctgaagaggaaccttcggttaatggataccactggaaaaataagtgatggccatgaatcagaagctactatacgcaagaggagctcatccaaagccactgatggagaagccaccaattctggaagtgatcctgcccctgaaaaagcaccatcaaatgaaggttcatcaatttcaaactctaacttagtgtttggctacctcaaccttttctcagatggtgttcataacttcactgatgggatggctctcgggagtgcctttctgctgcatggttctgttggtggctggtctaggactttatttctgcttgcacatgaacttccccaagaggtaggagattttggtatccttgtgcggtcaggcttcacggtatctaaggccttattcttcaatttcctctctgcgttggttgctcttgctggaacagcactagcattgtctttgggtaaagatccgggacattcctccctgattgagggtttcaccgccggtggtttcatttacattgctgtcgcgggagtcctaccacagatgaacgaccagaaaacaaccctcaagagctcagtagct

SEQ ID NO: 16515 - DNA, 591 bp, Zea mays
  Clone ID: LIB3279-231-Q6-K6-F7
cccacgcgtccgcaggaacatcgtgaagctgtggtgctgcttccacagcggcgactgccggcttctggtgtacgagtacatggccaacggcagcctcggcgacctcctccacggcggcaagggaggcctcctggactggccggcgcggcaccggatcatggtcgatgccgcggagggcctcgcgtacctgcaccacgactgcgggccaccgatcgtgcaccgcgacgtcaagtccaacaacatcctcctcgacgcccagctcggcgccaaggtcgccgactttggcgtcgccagggtcatcggcgacgggccggccgccgtcactgccatcgccggctcctgtggctacatcgctcccgagtactcgtacaccctgcgcgtcacggagaagagcgacgtgtacagcttcggcgtggtgatgctggaactcgtcaccggcaagaagcccgtcggggcggagctcggggacaaggacctggtgcggtgggtgcacaccggcatcgagaaggatggcgtggactcggtgctggacccgaggctcgccggcgagtccagcagggacgacatggttagggcgctccacgtcgcgct

SEQ ID NO: 16516 - DNA, 649 bp, Zea mays
  Clone ID: LIB3279-231-Q6-K6-F8
cggacgcgtgggttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgatgccactaagggttctgaccacctgaggcaagtttttggcaagcagatgggcttgagcgatcaggacattgttgccctctctggtggccacaccttgggaaggtgccacaaagagcggtctggtttcgagggggcctggactacaaccctttggtctttgacaactc

SEQ ID NO: 16517 - DNA, 184 bp, Zea mays
  unsure (1)..(184): unsure at all n locations; Clone ID: LIB3279-231-Q6-K6-F9
gtttgtcgatgcgaacaaagttgtttctgttagtttggagctggagttctgaatatttacttttataattttaaaataaactttgttcgactcggtccaattttaatattataaaagtaaatattaagaactcaagctcctaacgactagatagatctgnnggttgcttcgtcacacggggggg

SEQ ID NO: 16518 - DNA, 675 bp, Zea mays
  Clone ID: LIB3279-231-Q6-K6-G1
ttcttcttcaactacccgccgcgggaacccaaggaacgaggcaaagcaaaggcttctcgcagggtttcccgtcagcggcttctgcggcgggcgccatgaacagcagcaagcaggcgctgatttacagcttcgtggccaagggctccgtcgtgctggcggaacacacggccttctccggcaacttcagcaccgttgccgtccagtgcctccagaagcttccccccaacagcaccagatccacctactcctgtgacggccacaccttcaacttcctcgtcaaccgcggcttcgtgttcctagtggtcgccgatgaggcggccgggaggagcgtccccttcgtcttcctagagagggttagggaagacttcatgcagcggtatgggtccagtatcgatgaggaggggcagcacccgctcgctgatgatgctgatgaggatgactttctgttcgaagaccggttcagcattgcctacaaccttgaccgtgaattcggcccgaggttgaaggaccatatgcagtattgtgttaatcatccagaggaaattaacaagctctccaaggtgaaagcccacctatcggatgtcaaagggatcatgatggacaacattgagaagatttggatcgcggggagaagattgagcttttggtgggtaagacagagaccctacagtcaca

SEQ ID NO: 16519 - DNA, 358 bp, Zea mays
  Clone ID: LIB3279-231-Q6-K6-G10
ctgctctcccggagccagagatccaaacgaacctgtgcgttggggttctccggggttccttgcgctggagggaggtttcgttctcgccggccatggtttggctgagaagaagcagcagcatattgatgcgaaatctctgagctttatgaagatcgccactcacctgcgccgctcctgcttcctccactccttctcggtcgtcttcctctactggttttatgtgatctcgtaacttgccctcccccggatccgccattccccgtgccctctctctctctctctctctctctctctctctctctctctctctctctctctctccgtcccctcttgcttctcccttctttcttgccttccc

SEQ ID NO: 16520 - DNA, 664 bp, Zea mays
  unsure (1)..(664): unsure at all n locations; Clone ID: LIB3279-231-Q6-K6-G11
gattaccccagcttcaagctcgtcatggggggggatggtggaactggtaaaactacatttgtgaagaggcatctcactggagagtttgagaagaaatatgaaccaaccattggtgtggaagttcatccgttggatttcaccactaactgtggtaagatcaggttctactgctgggataccggagggcaagagaagtttggtggcctcagggatggatactatatccatggccagtgtgcgatcatcatgtttgatgtaacctcaaggcttacttacaagaatgttcctacgtggcatagggatctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagcagcagcatgaagccgagcttgctgcagcagctgcacaacctcttnctgatgacgatgatgatctgattgagtagaaaggatcatgagtcttggacttga

SEQ ID NO: 16521 - DNA, 608 bp, Zea mays
  Clone ID: LIB3279-231-Q6-K6-G2
ggagacctatcgattgaatttgtgcagtgaagggagtcttgtccataggatatgttctcttaacgtaaatgtttaatgagtttgcacatggtgcatattgagtttgttgccaccataaacctgcaccaagatatgaaacaaatatcacaatgaaaggagacttactgattgtccaagcaagactaaaaaaggctaggagaaagggagccagtgcaatcttgtacgagtttcttctaaacatgcaaaagctaggagaaatggagcgaggtgcaaccttttatgtgtttattctaaacttgcaaaagttatctatattttcgtatagagtgagtcaggtagcattgaggatacatcatagcataaataactttgcattggaattaactatctcttttgtattggattagaaagtaacgacaatttagccttcatcagctattaggttcatagactttgaagcaataggttgtacttctcaagctatgggacaccacatatttttttctgaaactaagcttgtacgtatgcaatctgtcattatgatgtagctagagatgctaattgtatcattagatctggaagtccaaatcatctgattgcaagagata

SEQ ID NO: 16522 - DNA, 663 bp, Zea mays
  Clone ID: LIB3279-231-Q6-K6-G3
cctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagtaagaaaaacgaatctccggttctcttcttccttgttcgtcccgtggatctgttccgtggcgtccgatgcattcgatttctgttattatgtcatccgccgccgcgagtagattttgacctttttttcccgtcgtcgttgctttgccgtcgctgtctctgtcgtcgtcgtcggctcgattgttttggcttctgcaggctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatc

SEQ ID NO: 16523 - DNA, 502 bp, Zea mays
  Clone ID: LIB3279-231-Q6-K6-G4
catggtgctacttccctgccggcacagaactttatgcaaatcttgtgctgagaaatgcaagaagtgtccaatctgccgtgtgccaattgaagagcgcatgcctgtatatgatgtttaaacctcactaactcagcttaacaatacaaatttgtgcatgtgggttctgtcatgctgtgcatttagtctcgatcacaactttaagctgattgaggtttgcacttcagaaagggtctgcaatatatgggggaaatacaagtatatcatgtctaaccaaaagcatggatatgtggttgatgagcattgtcgttttggaccagttatctactgtaagtatgtggtcagtgtatttcccttccctcttgtgattggtagatgagtcagatagtcttgttcgcgtagcagcattttctcagggatatgcagttgttgagaagaaagtgaaacaaaaacagactgtaaataaaaacactgccttgtttgaatctagtccttgtttgagaag

SEQ ID NO: 16524 - DNA, 667 bp, Zea mays
  Clone ID: LIB3279-231-Q6-K6-G5
caaacatctattagctaagctctgaagccaagggttgtagaaaactgccgctatcagtagccgccactgcaaaatcaagcggagtactcctacatggattagagtaagatacttagcttggccaaggagggaactccgagctaaaacttgggcaattgaatttgagaaatggatggaaccaaatttgattgagaaagaaaaggcaatacttggtttcctccaattttctcatgttcggttgatcggatgtgtaggtggcagtgcagcaagatgagacctgtctgaagaatttggaagctgaaggtgagcgttggcggaaaccaagtctccaactgcacgcaaagcacaagatttagttccctccaatgtctcatcttcaaatgtctcaaatcaatgcaaatctcgaggcgttagtaggatcattattatcctccaaatacggtgttcctagttaagcaaagtaatgggctctttgtttgcaccaatttggcgtttcgtgttagacaatttcatatcgggtgaacatttccaaattcactactgacaatgtcatatatttgtggtttcagattggactgaggggccatcatttgttttttatgaagtaattgtgcaataaattccctataaaaagataactatctacaagtgtgctagcagtagaact

SEQ ID NO: 16525 - DNA, 553 bp, Zea mays
  unsure (1)..(553): unsure at all n locations; Clone ID: LIB3279-231-Q6-K6-G7
cggacgcgtgggcgcgaatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccggcgcgctgcccagcaagtgcggcgtcgccctgccggacaagatcagcaccaacgttaactgcaacacgattaattaaatgaggcgtcctgtgcgcgtccgggcgaggaatgcatgcatggnggagagtaataaagtaatgctact

SEQ ID NO: 16526 - DNA, 586 bp, Zea mays
  Clone ID: LIB3279-231-Q6-K6-G8
tactcctaaaacaaaagtaagtcgttgctattattggagagtttagaggcagctaaaaattggatgtttaaccatttaccattgttctggatgaccactctctgtaggtggtatgtaggagctcattatacttctggcgggtgttagaggacactaagcccaaagtcacatatctcgacattgtcgtgcttaaacataagcaatttcttcacttgaggttccagttggtgaaagtacattttgttgacatcctccttgaacaggttctagtggactggctaatttaagtgccattgatcttacttcaacgatgacaacgacaagattacaaaggaaaacataatcattctcttgtaacacatgttagaactctagttctttacaaattatcctagtccacgagtccattttttatctaattgatttgctaaactaaaattgtggcaccggaacaataccaagatagtaaagaagacaacttggtgaatgtctatttgttaagaatcaacatttatataatgaatctaatattcatgggacaactaacaaatttttaaagaaatgaaaacttttaactagccttgag

SEQ ID NO: 16527 - DNA, 654 bp, Zea mays
  Clone ID: LIB3279-231-Q6-K6-G9
ggaatatctcaattgatccctagctatccttcgatttttcttcaatagcttactaggatcataaggtgttggagcaggttcacattcgctataaccaaagcgactcaaaaccatttccacgtaatgggattgcacaagtgtgatcccaccattgccttctctcagtagcttaatgttaagaataacatcagcttctcccaaatctttcatttcaaaattattagacaaaaagtcttttgtctctttaatcacatcaagactcgtccccaagattagaatgtcatcaacatacaggcataaaattactccctcacccccaccataccgataatatacacatttgtctgcttcgttcacaacaaagccggtagatgtgaaagttctatcgaacttttcatgccatatcttaggtggttgttttaggccatgtaaacatttcaataacttacacaccatgccttcttgaccgtttgctacaaactcagctggttgctccatgtagatttcctcatctagctctccatttaggaatgttttcttaacatccattttatggacgagaagaccatgagaggtagctagagaaagtagcacacaaattttggtcaatcgagccacaggtgaataagtatcaaagaaatcctcaccttcttt

SEQ ID NO: 16528 - DNA, 539 bp, Zea mays
  Clone ID: LIB3279-231-Q6-K6-H1
cagcgaggtgttcgacctggagctggtgcgcgacgccgccgcggggacggccgcggacgagcagctcatggacacgctgaagctcgcgctgcactgcgtcgacccggcgcctgcggtcaggccggaggcgcacgaggtgctgcggcagctcgagcagatcaggcctggtggcagcgagggcggcgctgggccaagcgaagaaggtggtggtggcgccgccgcccatgtgccggcggcttctgcttctgcgggagacgacgacgagtagcaagcaagcagcgccagacaggaatttaccagaaagaaaaaagaagcaatggagaaattaagagagagataatatatgtaggaattctttcatttgtttgtttcactggacggatcggattgatcattttcttgcgttcctaggtaatttccagtttgtataggcaaatattatttgctctagaatcatcgctgtgtagtgtagcaacccctacgacggatggaagagaggagaatactcctagtattaataatgcattattattattttt

SEQ ID NO: 16529 - DNA, 554 bp, Zea mays
  Clone ID: LIB3279-231-Q6-K6-H10
gttggcttctcctccccctccggttcgggttggggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgagggcgtcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctactgtggtggcggcggcggctaccgtggtggtggcggcggctaccgcggtggcaaccgtggcggcggctacggcaactccgacgggaactggaggaactg

SEQ ID NO: 16530 - DNA, 600 bp, Zea mays
  unsure (1)..(600): unsure at all n locations; Clone ID: LIB3279-231-Q6-K6-H11
acccccgccaccaccagtccagcagcgggaggccagacaggcacacctcgaagaacaagagctggtcctcctggtaataagcgagagagagagagaggccaatggcagccaagtggtggctcgtcgcctccctgctgctctgcctcgccgtcgcatcggcggcggcaagagcaacgcccggggactgcgacactactgccgccttcgcggcgggcgacggcagtgccggcgccgtggacgaggacgacgagcaggccaagaccgccgacgtgttcggtgggcggaccggcggcggcggcctcttcggcggcgtccacggcccgctgggcggcggcgtcgctgggttcggcccgttcggcggggccgtcgccggcgcgggcccgttcggcgggttcggaggcggcggcggcctcngtggcggaggaggaggaggaggaggagcangtggcgccggcgtcccgtgagtcttgaacaacgctgtgcatggccatggatgcatgcgtgcgtgcgcgtgtaataaggcgtgtctgtactctggactgtacgtacatgccgtgtgcctgtccgctcttgtgatgaaggattgggcgtacgtatgtc

SEQ ID NO: 16531 - DNA, 633 bp, Zea mays
  Clone ID: LIB3279-231-Q6-K6-H2
cccacgcgtccgcggacgcgtgggcttttccccactcccgggtctccagcattcctatcctctccccgcccgcccgtgccgccgccgccgccgccgccgcggcttcccttcctctcccgagccaagatgaatgttgaaaagctcaagaagatggcaggtgctgtgcgcaccggggggaagggtagcgtgcgcaggaagaagaaggcagtccacaagactacaaccacagatgacaaacggcttcaaagcaccttgaaaagaataggagtgaacagcattcctggtattgaagaggtcaacatctttaaggatgatgttgttattcagtttgtaaatcctaaagtgcaagcgtcaattggtgctaatacatgggtggtcagtggaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggccgcggaagagaaaaaggagtcctcatgattttgctac

SEQ ID NO: 16532 - DNA, 533 bp, Zea mays
  unsure (1)..(533): unsure at all n locations; Clone ID: LIB3279-231-Q6-K6-H3
ggcganctttgaaagactaaggaactcgggggctgctggnccaacaatactgacagcaagcgcccgactgcgtggggaggatgggattgcatgtaccgaggcagaaggactcacctggaagccctatagtggggctctgaacattgattttggaaagggggtcagaaagataaatgtctacttattgaatttgcctgaagtcaagagtgctttcaagatattaggtgtgccaactgttagtgctcgatttggtactgctcctttcttctggaattggggaatgcaggctttcgcaaactttttacctgttgagttcttgagggatagaaataaagttcagaagttggttcagtctgttgatcctttggttcgagccgttgatggtattgcangagagcatgtctctatgagagtagatttggactgctcaaatggtcggaatactattggattatttactcataaaaaactatttgtatcggngggatttgcaaccgctgcatttgctttaacagttcttgagggcaacacac

SEQ ID NO: 16533 - DNA, 281 bp, Zea mays
  Clone ID: LIB3279-231-Q6-K6-H4
gtaatgagagacaaatggaattgtcaggcaagccatctgaaaatcttcagggctccaagtttgagaaccaagatagacaactggttatcgagtctggtaaacatagctccgatggaagtttacaatcaaatgagccggaagggcaataaaatttgtgtactcaagcgctttgatgacatttgctttgttgcgtagtgttatcagctttgtggctgtagctgtagatagagaagtgttggaacagtgggcttaccggtttacatagtgagcagttaatatgg

SEQ ID NO: 16534 - DNA, 653 bp, Zea mays
  Clone ID: LIB3279-231-Q6-K6-H5
cggacgcgtgggcgcgctcggccccggagccgtggctggtggccgcggcggcggcgagcgccagcgacgactcgtgcgtgaacgacgtggacagcttcgcgcgcaccgtggccgccgtcaagtccaaggccgcgtcgtgcgcgcggccggacatgctggcgtccgtgctgtcgcactacgccgccaagtggctcccggacgtggcgcctcccacggcgtcgtccgcgtcggggcgcttcctgccgccggagagccccacggccacgtggctgaagaagcggctcctcctggagtccctcgtggccgcgctccctccggacccgccggcgggcggcggcggcggctgctgcgccgccgcggccgtggccgcggccgtcgccgacgacggaatcacgtgcgacttcctgctgaagctgctccgcgcggggagcatggtgggcgcggacgcggcgctgctgcgggacctggaggcgcgcgcggcgagacggctggaccaggcgacgctgggcgccgtgatgataccggcgttcggccacggcggcgagcacgcgccggcgctgctcctggacgtgcccctcgtgctgcgcctcgtgcgcgggttcctcaaggagggaggcggcagcaaggccggcggcggcgccgccctcgtcggc

SEQ ID NO: 16535 - DNA, 547 bp, Zea mays
  Clone ID: LIB3279-231-Q6-K6-H6
gtgcatatcaccagcctcctcgcgcacccggtcccgcttgcctctccccacctactcgccgtcgcggtgccgtacgccggtgctgtccagtctagggtttcggccctcgcccgccgatccgtcccccccgccggccatgtcgaagcaaggagggaaggccaagccgctgaaggcgcccaaggtcgacaagaaggagtacgacgagagtgatcttgcttatttgcagaagaaaaaagatgaggaaaaggcgctgaaggagctgaaggccaaggcacagaagggcgcaattggaggctcgggtctcaagaaaagtggaaagaaatgagcattgcccacccacccatctccaaaacacctaagagaacgataagacagctgcttatctgtgttgcgcttcactatatgatatatgtggctgtgagacaatgttgcctcttgtattccgtgtttcgcggtgttccagttggtttgcttgatccgaagatgtttcagcctctcatctgctagctttgatacacgagttatttgctattatgatattcatttg

SEQ ID NO: 16536 - DNA, 650 bp, Zea mays
  Clone ID: LIB3279-231-Q6-K6-H8
gcccgctgctgccctccgtccgcgtgcagatcccgccaccaaccgatccggcgccctccagcatggcgggggcgaaggcggcgggagccctggctcttgcgctcgtgctcgcgctcgcgggggccaactccgagggcgacgcgctctcggcgctgcgccggagcctcagggaccccggcggcgttctgcagagctgggaccccacgctcgtcaacccctgcacctggttccacgtcacctgcgaccgcgacaaccgcgtcacccgcctagatcttggcaatttgaacttgtctggtcatctggtgcctgagcttgggaaactggagcatcttcagtatctggaactttataagaataacattcaaggaacaatcccttctgagcttggcaacttgaagaatctaataagcttcgacttgtacaagaacaacatttcggggacaatacctcctgcccttggaaagttgaagtcccttgtattcttgcgtctcaatggcaatcatttgactgggcccatcccaagggaactcgctggaatatctagtctcaaagttgttgatgtttcaagtaatgatttgtgcgggacgattcccacgtctggaccatttgagcatattcctctgagcaactttgagaagaacccgcgcttg

SEQ ID NO: 16537 - DNA, 654 bp, Zea mays
  Clone ID: LIB3279-231-Q6-K6-H9
cccacgcgtccggcatggcacgcatacaacagcgaatgcatgcaagggttctcaagacttcctacgagggttcaaaggtatacgggccgtagtctcccataccatgcgaatttcccctgatgaagatctcaacacattacacatcggaagggtgatctagccccacccaccttaccctaactactccttgcataacgcagcgactatgttaaacctgatgttatcgacagtagttaacatcgtgatcagtaactacatgactacggcagatgcaaaggacctcttcccgagtgaactcaaaccgagaactgaccagccggagctcgcgttgtaaacttcaacctgtgacagaagagaagagcatcttcaggaaagagcacaaacatctatatatgtagaattgtcaggagccaacagttacgtacggtagctaggatctgcacattggactccaggccaccgattaagtacgcgcttccatccagagtaactgcagcggcgtaccctcttggggcgctcatgggatctcccatcctccaggcgttgagccgagggtcgaagatctcaacgctagaaaccatcttgtctccattgtatccgcccattgcatatctgaaacacaagtcaaacctctggataagtacattgccagga

SEQ ID NO: 16538 - DNA, 592 bp, Zea mays
  Clone ID: LIB3279-231-Q6-N6-A1
acagggatgaaccagtccatgattaggttgatattaaaggcacaatactccaccgtcacataagcaagacaagcaggtgtagaactcaaaaaaaacatgtccaaacgacagcatttcaatgtaaagagtaaacattgagagctcaagctcgaaactaacagaaacagttttgttcacctcgcaaaactttaaaacaaaaatgcctattgcagtactacaggtccccgcataagacagtacacaattgctgatcgctggattgagatagcactacttcgatggcaattaactttactcgtcgtcctcatcgtcgtcatcagcaccaccggaggagttgagttggttgagcctttcaatgaggctggccttcctctgctcatatgtcagcttcttggggttgtacctcttatgctcctttggtggctgcttggttgacttaacaatggaaggatcggcacggatggcagcatggaccttcttgtacagcgcttctatttcatcagcctcaactcccttcttaatgtacgcactgaagtggctctggtacttttctgggtcctcttcagcaggttcttcatgtagtcagcaacat

SEQ ID NO: 16539 - DNA, 445 bp, Zea mays
  Clone ID: LIB3279-231-Q6-N6-A10
aggcacctgaacaacggggggaaagatggaatacaagggagggttacattcaaacgagggcagaagcagtagtaagtttccattaatctcatattagcggagacaactatacaactctttccagagcatcaagcaagcgaactttcaagaaacttattaagctctgcatctttcactctcaggcaatgcagcccaagcccaggcaccctccaagcaaattcctcagcagctttttttttttcaccttgcaaaaaaactgcggggagatcttgtacagggcctcgtccacagctcccttgggcttccacttgggctggtcgctcacccagggcctcctgggtcccttccttgccgccgccgggacaagggtttttttctcccccttcactcgaacaacccactttttgtaaccctagggcttggcaggcaactggggcaccttgaa

SEQ ID NO: 16540 - DNA, 463 bp, Zea mays
  Clone ID: LIB3279-231-Q6-N6-A11
aacccgaaaatatgcccaggaaattaatttttggggggggaaattaagcgggaatgggggcacgggtaaaacaagagcccgggggccaactgggtaattcgcccccccacttaaggggggggggggtctgaacaacccccttttttggccccctttttacgggggggaaccctggcccccttcttatacccagggggaaactaaaagaaagcccccacatatgggccccccccgggggctgcaaaggggccccacctcccccggggggggaggaaccccttttccagggccggaaagggccccccccccaaaaaggacaggggggcccccatgaccatgggatcggaggggaaaaaaatcctgccggggccccccccaaaacccaacccccccctgggcatgggcaggagctcgggaaaaaccgccccccccgggccccccaatgggaccttaaaccgggccc

SEQ ID NO: 16541 - DNA, 329 bp, Zea mays
  Clone ID: LIB3279-231-Q6-N6-A2
gcgatctagacaacaacattatcgtcggttccggctaggctcagggcgcgactagcatgggagtagtgcgatacttttgagagcaagggatagcgaggatcttggtctttggaatagtattgttaatgacattttttttccggttgtgtttctggagtaaatcgttgaacgacaaggcttcaggatgtctggatgtggattctgagtagaccttgaatccttgatgaagcagccagtcttggaaagaaagttccattttgttgttccaaaaaaaaaaaaaaaaaaaaaaaaaaaaaaaaaaaaaagggcggccactcgcgatctagaac

SEQ ID NO: 16542 - DNA, 614 bp, Zea mays
  Clone ID: LIB3279-231-Q6-N6-A3
gttgggaggtattgctttattcgcatcattagtgccagcctgctgcgactcctgtcgaggtcacctcggcaccagcctatttgcgatgtacccagacgacctcggttgcctgccatgtcgttaactgtgtcgctacacaaccaaggagcattacaaatattcagcctggagcacataatgctatccaaacagaaacatccaccactctaccgggatcccatcattgactaacccttttctttcctgccagctctcccattttttaataacaaataacaaaaaatgcatccctgtcaccaattggtcacgtaggccaaacatccacgtttcaaccagatagatctgccacaaccaaagtcacagcgcctgagcagcagtgttcaacttctcggcgatgctgatttgtgtccttgtgatgcttgacaggtataccagcgcaaggttatcctgaatcttgtcattgaaaagcttatcgaaagcagctggggacaatttcggcattgaagcaacagattcagagaccaaccttccgattctgttatcaggtgccacgcgtccttccacaacatcatcgacgtatttgtagatctcatcaataagaatgtaaagcttct

SEQ ID NO: 16543 - DNA, 557 bp, Zea mays
  Clone ID: LIB3279-231-Q6-N6-A5
gaaagctccaatctaacccacattcattcggatccactcaatataacgacgaacacaaccggccatactcgaccccaatgacgacgcaacacacccacagccagacggccttcgcaaatcccttttgtccggccaaaggtctctggcattccaatactacagcagaaaagtcttcgggctataaggaaactgaaacggggaacacagcgacagagagagagggagagagagaaactagggaaaacgctaacagctagccagctgctctccggcagcgacgagatggagccgcaacgctctagggcgccatgcctgcccagttccacagcctgccttggttggtcaatagttcccttgtacagcaattcagtcgagctcttggggacgtcgaccgtcgctcgcggctagctatggagcatcagttgggcggtccagctaaccggtcttagcgactccgttggcgagcacgggtttctctgttgctgcttgggccacctttgccgcgtaggaaatagctggagtggcggtgccgttctctgcagaagccttcgctgcct

SEQ ID NO: 16544 - DNA, 565 bp, Zea mays
  Clone ID: LIB3279-231-Q6-N6-A6
caagtccgttttgaaaaacatggaatgcacgaaaatggatgttgagacataaagggcattatcacaggcctcccacaggtaacttttgttctacaccacaccagatttttaagacaaggggaacacatatgaccctcgcacgattttcactcactaacagattggtaaaatcatgaaccagttgcctagatggcaattgagattcataacaccattggaaatctctctgtacgagggtagcgccttctgaaccacatagtacaacggctagaactgggacttgtcaaggctgttaaagtagggatgctccatcgcagctaaagctgatatcctgtttgaaggatcaagctgaagcattttcgatagaaggtcaactccttcaggttccagtgttgggacgacacgtgccaaaccctggggcttccactgtggaaactcatgccagtcccttaaatcactcactccaggccactgttcctcagtaggtgttcccagcaacctgaagatgtgaagcaactgttgcaactccgagtcaccaggaaagagagcctgccgtcgggccatt

SEQ ID NO: 16545 - DNA, 557 bp, Zea mays
  Clone ID: LIB3279-231-Q6-N6-A7
agccatataatgagttcttcatatctcagatacactccacattaagttcaactcccatcgaggctcaaagcagtttataagtaacataaaactcctagcacataatcattgatagcaaaaactagagcgataaggagtaataggcggtaggaccaccatcagatccccgcgaagcgcctagtcgatctcctggagagacgcgccagtggcggcggcgccaccagcagcggcggcgacgtcgtcggcagtaaacttgcccttagccttgtcggcggcgcggccccgggccttgcggtcgaggagcgccttgcggtccttgtcaagcttcagctttgtaaccatgaccttggaagggtggatgcccacgttcacggtggagccgttcaccttctcgcgggtgatccgctcaacgtggatgacccagcgacggcggtacacctgcaccactttgccctcacggcccttgtaggtgccgcgcacgacctgcacctcgtcgtccttgcggatcgggatggaacgcacattgtacttgtggcggagctccgtcgatagcgccg

SEQ ID NO: 16546 - DNA, 633 bp, Zea mays
  Clone ID: LIB3279-231-Q6-N6-A8
acacgcactgtaacacaattcttgacattaacgaacaaatcggccacagcattgcgcgcaaggtccagcagcgcacataacactgctagtccagactgtcagcgcatagttaacttaagtattcgaccctagcaataacaccagcaaaggtagcagcaacagtagcagaagagaaacttgcgatccacaaaacaaaccctactcatatgtccttacaatggcaccagattaacaataaccccaggacttcatgtttttgtcacgatgtttgaggtggcgattaggccctctcgccgcggatcctccttgccagctgaatgtcctttggcatgatggtcacacgcttagcatggatggcgcacaggttggtgtcctcaaacaggccaacaaggtatgcctcagcagcctcctggagggcaagcaccgcatggctctggaaacgcaaatcagttttgaagtcctgtgcaatttccctgacgagcctctggaagggcagcttcctgatcagcagctcagtgctcttctgatacttgcggatctcacggagggcaacagttccagggcggtagcggtgaggcttcttcactccaccagtggtgggggcagacttacgggcagccttggtggcaagct

SEQ ID NO: 16547 - DNA, 604 bp, Zea mays
  Clone ID: LIB3279-231-Q6-N6-B1
gtatatgtgtacacaagtgaatgcattgattcatcactggttggatcatatattacaaaccaccaagtcccagcggtagctctcctaattaacgagatctccattaacaaaggatcgatcttgccatcctctctctcccactcatcacaaaacgagaccacgcacgacgggttgatccatccccaggctcatagagatcgtagttaattaatccaagaacacgttccggccggtcgatggacggggcggagcaatggcgggcttaagaggaccctccgaacgtgtcgaagatggtggtgtggagcgggtcgctcaggtgggtggcccagttgttgagcggccccttgccggtggcggcggcctgcacggcgaagccgaggaaggcgaccatggcgagccgcgcgtgcttgatctccgccagctgcagccgctccttcttctcagggtcggccgccaggccgagcgggtcgaagtaggagccgccggggtacagcctcttctccgggtcgagctcggcgttgcgctggaactcgatgtagccgatcacgagcacctcgatccagatgagcgtcgagatggagaacggcagcggctggcccaggta

SEQ ID NO: 16548 - DNA, 598 bp, Zea mays
  Clone ID: LIB3279-231-Q6-N6-B10
gcgaccaaagccgatgcacaggggagcattacattaatcaatcgcgaagtcacatagaatacatctcttactctgttaaagtgactactcaaatgaatctcacaagaaaaatggtcaatggtacagtaataagatagtaacacaattccgcggcgacaagagatcaagaactctcacacaaatagtacatgaaccacaaaataaaaaacagggcgacgatggccaacgccgtcctcttgaactctagttgtagtacataagctgctgggctgatgactggttcgggtagccatcgtagagggcctgagaaccagcagcagcaagaagacctgcagaaacctgacccgcgagaccatgctggccagcaatctgccctgctgcagcctggcttaaggcaagctgcctctggtaagcaagaagttcggctgctgtgaaaccttgtgggacacctgacattgctacagcaggctggtatgaagcaactggagggggtaggggcttggaggtggtgccaggtggagttggcttgtttccccatgagcacttaattgatttcccacggactaccaatcccatggccatctgaatagctaatgct

SEQ ID NO: 16549 - DNA, 551 bp, Zea mays
  Clone ID: LIB3279-231-Q6-N6-B11
ctctagaagcggcgcgccctcttttttttttattttttttttttttttttttttttttttttttttttttttttttttttttttttttttttttttttttttttttttttttttttttttttttttttttttttttttttttttttttttttttttttttttttttggggggggggggggggggaaaaaaaaggggggggggggtaaaaattagggggaaaaaggcaaaaaaaaaaaaaaaatttggaaggtaaaaggtaaaagggacttaaaaaagggggggccggggagcaaaagccccaatccgaaagttaaaggggaaaagggactttaaaaagggggggggggttacccccaagggggcccccatttaaaaaaggggttcttgggcaaaaaattaaagggaacaaaaaaaaaaaggggggggcccctttaagggcccaaaaaaaaaaaaagggggggggccttttttttaaaagggggttccaggaaaaaacggccccccttgggaaacgcgggggggagacttggggtaaaaaatattttggggg

SEQ ID NO: 16550 - DNA, 616 bp, Zea mays
  Clone ID: LIB3279-231-Q6-N6-B2
gaaaaacagcctatactgatgaattattggcaaaaaccaaaagaattgtcagccatcaggaagcagcaggagggggcgctgcagccgtgacggcgagcaagagtatagtcattcgggggggaaaaggcctacatagctacctttacagagctgttgctatgtatgtatggaggagcttcagaagtttcgtatctggtatactactactctcaacaaagctgtatctacacaacaggcctcacgagctcgacaggctcgtcgcggcaggtgttgccggcaccgcgctgctctgcgtcgagttgttcttgttctcgccccagtgccatagcatgctctcccagaagcagaacttctcgaagcaagtcttcagcctcggatcggttatgttccgtttccaatgcccgtcggtgaagttcgccttctcggcctgccgccgctcccactccagcccagccttcagccttgacctcaggaggcaatagctctgaagcttcttcggcatcttgttgtgcaccttccaccagcgggcatgcgcaacgtcactcgcgaattcccgcaagatctcgacgttccagttgcaatcgtagtcccggaagcacagccatggcttccgccc

SEQ ID NO: 16551 - DNA, 493 bp, Zea mays
  unsure (1)..(493): unsure at all n locations; Clone ID: LIB3279-231-Q6-N6-B3
cgacaaccctctttttttctgttcattttttcacatgtcgatgttgtttacattcacattgccgggtggttttacatgctgctggggcaggctccccattccaggggccctcagcctggtcccaaaatccccggggacgggtaagttttatcaggtcttatctccagacccattctctggggccccngttaagtcgcacccttctaaaggccgggcctggcacccgggggcggcggcttggctctcttctcccgttccttctccttttccctgcccccggcctctgcttgctgccgcctcagctcctccatctcctcctccttcgccgccttctcttccttctgcctttttttggggncnngangagaggggtctgtttctcttcccgggatgaacttgggccccctctccccttgcccccgggggtcacctgcggggcccccccgcctgtcccccttgggggtccggccccgcccctgggggccccccttcc

SEQ ID NO: 16552 - DNA, 563 bp, Zea mays
  unsure (1)..(563): unsure at all n locations; Clone ID: LIB3279-231-Q6-N6-B4
aagacagaaaaactctggttcacgagtaaatcccaaccagcatagcaatctacggctgaattaccaaatataaagacaagtagcagtctttccagtactttccaacataaaacaagcttaaaatctaaacatgactctggttttcctctggtttcactgcccaaaacaatactgtgatgactgtgcagcctagtcgaagaggctgaagcccatatcatcatcgctttcttccttctcttccaccttctcttctttctttgcctcagctgcagaagcagctccgccagcagcaggtgcagctgccgcaacagcgacaccgccgccaccacatgggactgaagcaaacttctccctgcccgcggcaatgagctcggtgatgtccttaccgctcagttgggacagcaggagttccatcttttcattgtcaacttcacagccaactgactccagaatggcagtcaaatcgtcagcggaggggctggcgttcccagcgaggacagcaagcaggtaggcagcaacaaacttcatcgtgctccgaggaaccggtcgaccccacgcgtncg

SEQ ID NO: 16553 - DNA, 508 bp, Zea mays
  Clone ID: LIB3279-231-Q6-N6-B5
aggcttcaaaatctctcatttttcaatgccaaaggcgtccgacacaagggttaaaaaggccaaatttgaagggccaacagcccaagttgaagggaaaacagcatctagttatagaaccacataagtggccccgatgatagaaaattaagccacgggtaccggcatcgatctggcaaggtgggacaacacaggcaactgtccggcaagagcgggcagcccagcgctcaacgggaggacttttggaacctggggcgggcgccacgaccaccgaacttttttggctcgcaacgcctggggtcggcgaccaaaagggtgcggtcgtacccggtgaaaatgtccttgacctcctttttggcggcctcgtcgacgtacttttggtagtaggcgacgagccccttggcgacggcctggcggatggcgtaaatctgcgacgtcttcccgccgcctcggacgcggatcctcatgtcgatgtccttgaacctggagcgccccgccagcaggatgggct

SEQ ID NO: 16554 - DNA, 609 bp, Zea mays
  Clone ID: LIB3279-231-Q6-N6-B6
acttacttacggcaataatacaccaatcaaatcggctatatgaaacaattgttgctgcatatagcagcagcagcttattactaggcactagttattactaggcactagcaagttctcacttctcagtggcgcttgaaaaactccaccatgggcttgtatatgagctgcggggcgttgtagcccatgatgaagtcgccgtgcgcgtagtcaggcatgtacagcacctcgatgtcgtcgctgtcgtgctggctgagcagcgtccgcaggaggtgcctggtgtcggcgacgtcgccgaggaagtcctggccgccgtgggtgaggaacagggggacgtggcttgggatggacgagaggttgtaggttgggggccgcgtctggttgtagcgcttcgtgttctccttctcgcttccgtagtcgtacttcctgatcgtctctttcctgaccactgatcgatgacacacatggatcgatgtattttacacgagcaactggggaacagattccttcgttcctgataaagattaattcttgtgtacgctgatttcttaacgaagaagaataaataaaaggattatattcttacgctgcgacatgtggatcatgttcttg

SEQ ID NO: 16555 - DNA, 635 bp, Zea mays
  unsure (1)..(635): unsure at all n locations; Clone ID: LIB3279-231-Q6-N6-B7
tgatgagcacggtcgcgcacggcacggcgccgcacaccgtctggatggtgctcggccagggctccgggatcgtcaggttcatgctgtcgcccttggtctccgtgtacgggtgctcgcccacggccacgatggcgtacgagaagccgccgttcctgacgaagtccgcgtcggggttctccgcgaacaccaccgccgtcgacgggtccacggccgccttcacggcgtccaggagcgtggtgccgacggtgatgcggcccgtgtcgccctgccactcgatcgtccacccgccgcactggtaccccaggttgtcggcgtggctaccggcgaccaggatcttggcggccttcttgggcaggggcagcagcggcgcgtcgcctggcttgccgttcttgaggagcaccagcgacttcctcaccgcctcccgcgccaggtccctgtgctcctgcttccccagctggtcggcgaggctagggtcgggcatggggttctcgaacaggcccatggtgaacttgacgcgcagaatcctcgtcacggcgtcgtcgatcctgctcatcgggatcaggccgctgntcacgtgaccggtcaggatggtgatgaagtcttggtagttgttttgcaccatgatcatgtcaatg

SEQ ID NO: 16556 - DNA, 555 bp, Zea mays
  Clone ID: LIB3279-231-Q6-N6-B9
aagggggtaaactcgggtgcgtctcatatgtgccaaagaagaagaacacatacaatgaccaagtgtatagagataaatgtcacaaacattattacataacgagaatgtcttacaaaataactgataaaaataaaatgaactaatattatttccttgacgccattaagtcgactgggagatgactcctagacctcgtcaaactcctcgtagtagtgttcctccgaggccacctgctcttcaccagagggtctgtcgcgtagcgctccggccacagcagagctcgatccacggcagtggcttgcgtcagtgagaaattcccggcgagcccggccgaatccttgcacgagagaggttcgcccaggtcccttacggcacgttggttccccaggacctccacacgagcactggatgacgtgatggcagaagacgacgtcggcaacgccctagacctctactcccttctaccttctctccccatggtgattactctctatgaggcgaaaggagtgcctgtgaatagccgcatgggtcggtgccttgggatttttaggcacc

SEQ ID NO: 16557 - DNA, 611 bp, Zea mays
  unsure (1)..(611): unsure at all n locations; Clone ID: LIB3279-231-Q6-N6-C1
ttttttttttttttttttttttttttttttttttttttttttttttttttttttttttttttttttttttttttttttttttttttttttttttttttttttttttttttttttttttttttttttttttttttttttttttggggaaaaaaaaaaaaaaaagggggggcgaaaaaaaaaaaagggggggggaaaaaaaaaattttttggggggggggggggcttttaagaaaaaaagggcccaaggaaaaaaaaaaaagttttttaaaaaaaaaaaaaaaaaggggggaaaaagggccccaaatttttaaaaagggggggggggaaaaaaggggccgaaaacaaaaagggaaaaaaaaaccgggatttttaatttgggacccccggtttttttgggggggggttttgttgccccccgggggggggggtttaaaaggggggggcccggggggggggctttttggggggggggggggggggggaacaccggaaggggcctcgggggggggaagaaacccgggggggggggggggggggggccccgggggggtttctcctggggaaaaaaaaccnaaatggaaaacccccgggggggggggggtgtggggggg

SEQ ID NO: 16558 - DNA, 602 bp, Zea mays
  unsure (1)..(602): unsure at all n locations; Clone ID: LIB3279-231-Q6-N6-C10
ggggcacgtcgacggcgacggcgcaccgcggtagccagtggtcgggccggaacgcgtcggggacctcgacgccagcgtccttccgcagcagctcgcagagctgcgcatggaggccgagcagcgcggcggttggagtgggcgcgaggaagagaacgttgtcgtgcggggaagaggaggcggaggccgggagcgcggcgagcgaggagagcgcgagcgcgagcgggtcgaggcgcgacgcgagcgcgcggagcgagggtgcgaggcggaggagcggatccccgcccgcgccggtgccaggaggcgggagcgcggcggcggggaggtggagcagcgggaggtgcgggcgggcggcagcgtcgatgaggcggctgcctagctgccgccgcgccagcgcgttccacgctttgagcacctggttctccagcgccgggtcgaaatagagctccacggcgtagtagaatccggtcgggaaggtagatggcggaggcggggcagcccggggcgtgcccggaggagtcgtcnagaacggcggggccgaggggcagccgccgccgccggccccggctgcggagggcacggtgccttgcgccatcggggatgga

SEQ ID NO: 16559 - DNA, 386 bp, Zea mays
  unsure (1)..(386): unsure at all n locations; Clone ID: LIB3279-231-Q6-N6-C3
cgtcgtaactttttcctctaacggccgcctgcggctccggtttccgcacggaagttgggaaggtttcttgaggctgagacatggtgctgaagacgactttgccgttcagcggccagaagattatcctgggaaagcattagatttatccggctgattctcaggtcttcctttttgccgactcggatgcaagcgctcttccaccccgcctgaaaccgcaagctacctgccagcantgccaggacgcgcccangaaggtntccatgctgaagcgcnnnagagagcgccgcgcccccnngaagcctctccggncanngngggtgctccttggnngtntcccccagagaagctgnaagccgagtccgcntgctgctgagaagctgctcttc

SEQ ID NO: 16560 - DNA, 613 bp, Zea mays
  Clone ID: LIB3279-231-Q6-N6-C4
aatacaacacaaaaccataaagcatgaactttagtttacacttcctcttattttggccaattgtattcacaaggtatgacgctactgatgaaactgcacaaagtccaccgaattgacaggcgcccttgggtacatagcagtgagactggaaaggtaacaaatggaatacggatacgtagataaccacggagacccagcaatgctaaggtattgtttggtcactgcataaccgacgatgatgatcacaacgcctcgtgatgcctcgtgccttaacagcaaccagatgatctctgggcccggttgccacccaccacgtccacggtatctggcacatacagttcttcctctggctcattcttcagagcgttcttcacgatacactggaaggcgtcttccacgttcgttccgtccttagcagacgtctcaaagtacgggatgttccctttggaagcacaccatgcctttgcctttttctcagataccacgcggctgttgccaccatctacatcaactttgttacccaacagaacaaaagggaaattatcaggatctgatgggctagcctgaattaaaactcttctcgccagttgttcaggttgtcaaatgatttcat

SEQ ID NO: 16561 - DNA, 591 bp, Zea mays
  Clone ID: LIB3279-231-Q6-N6-C5
agctcaagaaggcaattgctctgttaatctcgcctcccaagggcactgtgcgggggtatttataggtgcctggatgcccagcgtcttggattaaggacgcatgtgccctcacgcgcccaggttatccccggaatattcccataaagtagggttatagactgtaattacagagaagtctttacaaattaggcctgtaatgcacagcggccacacggggcctgttacaatgggccaaatcacatgtgggccttcgtgttggacgaggccgcgggatggggcgacctcgtcgtaggccttcgtcctgcgacgtgttggacgaagggtggagactgccagtcgtcttgcctccgttggtgcagcgagattggcgaaggcatcgagcgaagggtagcgtcttcgccttcgccccaacaaccggtaagaataaatattacactttaacttagtcaaaagatcgagaaaaagaatgagttgaaaatgaatctgaccccattttatagctcgttggattacccatcctcctttagatagcgggtggtactatgtggaagcgctacactccgtacgacttcacgttgtcttgatcttggc

SEQ ID NO: 16562 - DNA, 562 bp, Zea mays
  Clone ID: LIB3279-231-Q6-N6-C6
aaaacaacaggtgtggcccatttctgaattgcacagactacagttaccagtcccatccaagtctcagctcgtgacatgaagctacaaacaacaggtcattagctgctggaagcaaacaaacagttcaaaccttcttccgattgaaaaaacaaagctgagccttttggaacctgcatccgaggcaagagattatctcaaccaaaaaggaaaacaaggcctcaagtttcaattacttggtgtaattgaacttgacggggttttttttttttttgcgccattagaacctgataacagccagacaaaggttgcaaggtatcattgttactaaaaacctaggactgtatacattttatacaacattgcttcaggtcagcagcctcttcgggtccgagctccgcttgaagttgtacaccgactcaaatgcctccatgcacacgctggcgaagcccgtcatcgcctggaaaacgttagggaagccagtctgcaggttattcagggtcattgctctggtgaccccgatgctcttctcgtatttgatcttctcctcgtcggcacggctcct

SEQ ID NO: 16563 - DNA, 629 bp, Zea mays
  Clone ID: LIB3279-231-Q6-N6-C7
acctccccctccgccgcgtgcaggaggtggtgggcgccgtcgtctctgtccctggcggcgtccctcgcgctcgccgcggccgtgcagctccgggtgggcgcctactggcgcgccgcggcgcggctgcgccgggaccgcggcgacgcgcgcgcactcgcgcgggccgtgcaggagctgcgcttgaagggcgccgcgttcgacctgtccaaggagccgcagtacggggtgacgagggccaagtgcgccagcgtggagggcgcgggcctgtgggcgccgctccggtggttccggcagaacgtcgtcacagcctgcctgctcgccgtcgccgccgcggccttgccctccggcaagttcatcctctgcgcctaggatgcatggatgcggggtcgccagcttctttaaggctcgttcggttcctccggaatgagcgcctggaataattcacggttggatctttataagctggaatgactctggtgctcaatcctgatgaaccgaacagaccgctgatcttcagaaccaaaaatggggactgctcgccgcacagggaacagagacaccacttgtgctccctaggcaagatccccatgaaatggcagaaatgcgcattctttcttgtaattttttct

SEQ ID NO: 16564 - DNA, 593 bp, Zea mays
  unsure (1)..(593): unsure at all n locations; Clone ID: LIB3279-231-Q6-N6-C8
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgncggtgccgttgccgcgggtgaagtcgccgncctggcacatgaactcggggatgacgcggtggaag

SEQ ID NO: 16565 - DNA, 611 bp, Zea mays
  unsure (1)..(611): unsure at all n locations; Clone ID: LIB3279-231-Q6-N6-C9
aaatatcaatttatatatanttgctgtcttgatttacaataattggtacatcaaacaagcgcccttgatgttccaaccaaaaatgaggaaaaaacattacatctgatttctgaagcaaaccctgtgtcattgatttctgaccttccgaaaacgacaggccatcatcaagtcaagtatagacaatatccaataatagtcttgactcactcatcctatcggatatgtttgaagctgttgaacatcccggtgtgggaagctttggctgcaggcttgggcgtttcaggggttccaaaaacgttccagaaccggagggtctcgtcagcagcagccgacgctactgtgcatccatcaggactctgagccatgaagaggacgcgagaggtatggccattaagttcagccatcttcaccatcgatgggtacttccacaaggtgagttggttctgtgtgaatccatgtgagctcagcagctccctctcgttcttgttccacagcagagcgcacacctgcgatccggtatcaaccgagttcatgcacacaccggtgtgcgtgttccagaacttgatgcagcggtcgctgccaccgncgccggtggccagcaagttgctctg

SEQ ID NO: 16566 - DNA, 618 bp, Zea mays
  Clone ID: LIB3279-231-Q6-N6-D1
agaaaaaaaaactcacagattggatcggtttttattgctagcgttgcatagaaaatccgttgaggactcatattttctttttcagacatacgtactactttttattatgcgtggcacgtactacacgtaacgcaaatagaccaaatagagaagctattactactagcagccacccgaaatgaatactccacttgcacagaaagagacgccgtgccccagcaatcatcgcttgacacggcagcaggaccgcgcgccacgagtgacgctctgctacctcgccctgtcgcccagcccagagaccggcggcgtccgcgtccgtccgtcacagcgtccgcgccgcggcaccatgctcggcagaggcgccggcgccagcgccggccccggccttgacgcagcggtcgaagccgtaccagacgccgtcggggagcgggtcgccgtagtagaaggtggagggcgcgccggacgccggctcgtacaccctgacccactcgggcgtccacccggccgcgcggcccgaccggcgcaggtagaggtagcagacgccgtagccgcagggcccggcgacgcggaacgtgtccgtggcgcagcgctcgaacccgcgccgcggcgtcaccgtcg

SEQ ID NO: 16567 - DNA, 533 bp, Zea mays
  Clone ID: LIB3279-231-Q6-N6-D10
ggggacagaacatcaaaaccatctatgcgttgttattttgaagctggagaaaaataatcctgaacattaggcagtttaattaggagggcgaaggggggagtgcaagaaaaagcaacattcgctcacagttttagtaattacaaggggggttaattggacatccccaattctgttctgggacttcctgcctccttagtccttcctgcagatcggtatatgtttctttgttcctctccccgtcctaaattttcttttcatctaagggttggggatgttgaaggcaaaactggccttttctctaccatctcataggggaaaacaaaggtgtccttgcgtattgggtcccaggattctgggtcaaagcaatagtaagatccacgttcatagaggggagtttttactagaggttccacatttgaaattctggtgagccataagtgcacttctttatgggaaaaccatccccgattatacagttcattggcagagtacagctgagcttcatcttttggcatgctatagaagacgaaaaa

SEQ ID NO: 16568 - DNA, 596 bp, Zea mays
  Clone ID: LIB3279-231-Q6-N6-D11
aaatcaacgtcttcgatgaacattaaccaaacagcaccgacccgaaggaaggcaagcacaggtgcatataggcgaagcatgtccaaccacctcactatggtggatggcaacgatggtaggccgacgacatacatacactacaatacaatacgatgatcctagatggatcagggatacatacgaccaacaacaaatccaagggaacaatggcgcccagacgagcaggaaagcgttcgtcagcccatcgcgtacttctgcgtccagctgcgggccgtcgactcgtacttcggccggtccgtcttgtacatgtgggcaatctccgggacaagagggtcgtccgggttggggtcggtcagcagggagcagatggagagcaggaccttagaaattgtcaaagcagggctccactgctctttgagaatgtcaaggcatatacttccattgctgttgatattaggatggaagacctttgtcttgaaagaaacctttggaggtttgaaggggtaatctggcgggaaatgaatgttcactaagaaaacaccaccagcatagggactgtcaggtggtcccataattgttgcttgccaatgaaacat

SEQ ID NO: 16569 - DNA, 283 bp, Zea mays
  unsure (1)..(283): unsure at all n locations; Clone ID: LIB3279-231-Q6-N6-D12
ccccccttttttttttggtttttttctctttttcccgtttcctccctccctttcctttcccccccctccccctcccttctttctcttcttctccccccctccttcttctccccccccccccccccttctnncccttttttttttncccnnttctttttttttcgtctccgcgnttttttttttttttttttccctttcctccccccccccccccttccctttcctccctccctcccccctttcctccccccccctcttttcctccccccccccccccttcccc

SEQ ID NO: 16570 - DNA, 310 bp, Zea mays
  Clone ID: LIB3279-231-Q6-N6-D2
agcaatgcattaccaccatgactaaattcataacacaggcaaaagccactgcaccacttacacacaccagccaaccaccactactaccatgagaagcggcacatcacagtgcttgcttgagaagcagacaacaacgacgcctactacaagggggctaagacgaggggaacttggtgacggccttggtaccctccgagacggcgtgcttggcgagctcgaaggggaggacgaggcggacggaggtctggatctcgcgggaggggatggggggcttcttgttgtaccgggcgagcttggcggcctccgcggg

SEQ ID NO: 16571 - DNA, 585 bp, Zea mays
  Clone ID: LIB3279-231-Q6-N6-D3
ggtaggctctgttctccatttttatcattcagaatcttgttattgaactaccataactcattcaatgggtggagcaacaggtttgatctccacttccccaggaataagcccaaacaacacaccatcatacaacttaacagactcctttaaatacaactgcttgagcttcatgaagcactgcagggtcagcagcgaatcagatccagcctggtggctgatcccaacacgctcaatcttgagcagctccccaagcttgctcagcccgccatataggccaccgccacagaacttcatgagatgcttgatgtcgtacatcaccggaaagaaggtcttggtgagtttcaggaactcatccaaggtgttgggcatttcccgtccggtgagcatcttgtggaggtagccgaagtcgtggcctctgtggaaggtcacccactggacatcgtcgttcagcacgactccggacgacatcatcagctcggcgaagcgggtggaatcgaccccctcagccgcaaagaggtcgaagtcgatgccgctgcggcggagcagatcgatggagtcgctgctagaatggtcggtgtgcgggtc

SEQ ID NO: 16572 - DNA, 592 bp, Zea mays
  Clone ID: LIB3279-231-Q6-N6-D4
ggtataaaatactatggtatactcaaaaaccatggtaaacaggccttcagttagctgctgatctttacatcggaccacagctgttagctgacaatctcctgtgttttgcaatttgttacgcatcgcagttctagttatctggtgagtttttgcagatggtctgctgtgacttcaattctcagtcgccaacgctcgacaaatacacacagacgatgttgaggctacaaaattggtaacccaactaactgggctacaaaattgggtctctggacactaaactaacactagggtcgactagcttgaaaaaatggccaccttcatgaccttgaaaaaatgtcagggagcagtaacacagcaacatcgggaacctatctgtccagttacctcgccttgcagatgcatccatggtgccattgatctcagacacggagacttcgtcccgttacaccgcaacaagtccattgtttcctatgttattatgtcaccaattgtcaactattgctaacagggttcggactggaaccacgtggcgggcttgaccccgctagcttctgcggtttactcctcaggaagctctttgtgtatagggcta

SEQ ID NO: 16573 - DNA, 598 bp, Zea mays
  Clone ID: LIB3279-231-Q6-N6-D5
caaagaaagttgtaacatgccattgcagtttaaacattcagggacaagcatttaattggaaacacctttgacatgaaagtccggattcagtcgagaaagtacaacaaagatctccattctgtcttgtcctagctcctccactaaataaaataatataaaaaagagtatgactgttttacctggatgcaagcatacaggatcactccatagcatcaccgccctcagtgacctcaaccttctgcttgagatgtgtgatctttgcggacagcacctcagtctgccccttggtgaagctatatccctttgaactaacataagttctgggattcggcaactggtggtttctcaagtattctgtcttccccttggttatcacgcagacatccacattgcttccactacccaagtcattgaagatacctgcacatattgcttctgacaccagttgtattccctcttccctagtgaggccctctttatacttcgattcaaacactgacattgcagcaagggatccagaacccatcgtggcaaaaggaagatatcagtggagccgtgtggataaacagtgtgaagatgcggtccagtacaatccact

SEQ ID NO: 16574 - DNA, 633 bp, Zea mays
  unsure (1)..(633): unsure at all n locations; Clone ID: LIB3279-231-Q6-N6-D6
ttggtcaccttggcgccggttgggtccttcttctccacactcttgatgactccaacagcaaccgtctgcctcatgtcgcggacggcaaacctacccaggggaggatacgcggagaatgtctccaccaccataggcttggtgggaatcatcttcaccataccagcatcaccgttcttcaggaacttgggctccttctcgagctccttgccagatcgcctgtcgatcttggtaatgagctcagcaaacttgacggcgatgtgggaggtgtggcagtccagcactggggcatagccgttgccaatctgcccagggtggttcatgatgatgacctgggaggtgaagctggcagcctccttggcagggtcatccttggagttggaggccacgaacccacgcttgagatccttgacagcaacgttcttcacgttgaagccaacattgtcgcccggaagagcctcctgaagcgcctcatggtgcatctcaacagacttcacctcagtagtcaggccagttggaccaaaggtgactaccataccaggcttgatgacaccagtctccacacgaccaaccggtacagttccaataccaccaatcttgtacacatnctggaggggcagacgcaggggcttgtcc

SEQ ID NO: 16575 - DNA, 603 bp, Zea mays
  Clone ID: LIB3279-231-Q6-N6-D7
gaacacatcttatacattgagttattaatagatacacattttacaatgtgttaaataaaaccccaaagatcgatcatatgataaaatcacagccatgcttacttatttaaacaaaatacgccaccaacatcacgaacaattcagcacatcaagcgacttcagtgccctcagtggtcattgttgagcctcctgcagttcttcctgatctcaccttgtgaccctgtcagtggcgagatgtttcccatattcaccatagactgtgcaaagtgctggaagaagagattgacatcagcagcatatgccttcacgagggccgctgtctcagcgctcttggttaacagaatctcatcagagcttagaaggcccttgccggccaggaggttcttgtagtaaaaattgtcaaacttggcaggggtgatgaagtccaaggggaagaggttgttgtcaccaccagagcgggggcatccctgcctcagctttgcggcgtaggatacatccagtgtgctgtcagccatgccattgcctgtctggttgtatagcctctgccggaaactagtgcaccgagacataccaatggtgtgaccacctgagagggcgacaaca

SEQ ID NO: 16576 - DNA, 561 bp, Zea mays
  Clone ID: LIB3279-231-Q6-N6-E1
aattgggaagcataattttccattgattgaagtgaaataagtaaaaaataaaaataaacacttagtacgattacatcatgtctacttatggaacagagatagcatgataccttctttttttttgggtggggggctcaaacacgggggaaataccttctaagcgagttacctaaattgccacgacctcgtcagtcacacacacacaccagataatcacaaggcgggaaggagggcaatgaaacaaacatatcgctctcgaatgcctcgactcgctgcagccgccagtaaaatctaggggggagggggtgggatcatccattgctgtttcgctgaagcaagacgcggcgataatagaaccatggcaccttcgcccttgtttcttttgtctactgatcattattagatcacaaaatggagcacgcccccctctgcgcctttttcttcttcttcgccttaggcggctgcagcacaacctttatcgccgcatcgaagacacccttcacgtttagttgggtctttgagctgcactcgatgtagtatggcgcgcctatttgctttctt

SEQ ID NO: 16577 - DNA, 600 bp, Zea mays
  Clone ID: LIB3279-231-Q6-N6-E10
cacggacaatgctctcaatgggtaaaccaaaagtgtgaataacttaatcaggtacaatgctaagtggtagagagtagagactggccctcctagcgttcacacagctaatctgctcccagatggagtatgcttacatagaagcttaaaaactactacaaagtataccagaattctatattatgccaaacacaataaccttcgatacaacgtctactctggatcacactacatgctataggatatataagttaaagctcacgggaacgagaaaacatgtacacatgacattaagttgttcttgaagcttcaggcagctggatattgtccagaaatggtgggtgttctccaatgacgggcagcaaacgtgcatgcaagtgttaagccttcaagggctcttcttgttatccatatgggtgatatcgtccatatcctccagtgaagcttcccctattcatgtcaggtgtgctagcagatccataaccacctagcgtaggatcatatgccccaccataggcggtgccactaaagccagaactactagggccaccaaagctctcttcagcatcaccaccaaacccaggattaccaccaggggcgccg

SEQ ID NO: 16578 - DNA, 550 bp, Zea mays
  unsure (1)..(550): unsure at all n locations; Clone ID: LIB3279-231-Q6-N6-E11
aaatggcgaatctaacccaaaatattatcgggtagcaaagtcaggtttgctacatgatacaaattttcttgaactttaactgtgtttttctaaagaatttataaattttatccgggtgacgaacacccctagatccacccctgcaatccaagttttgtgccgtgaaatatcgcgacagatcaatgagcctagccgcaccatcctacagtcttgttcgtcgtgaagccagcatgcgatgaaccagtgtcctgctgaggagcgggctttggctgccttggcttggcagggtcaacgaagatgacccatccatccaggaacttggcgttcatctcctgccgcgctctctcggcctcttctatggtggcatatctcacgaaaccgaaaccctttgacctcccagaaactctatccgtcaccacttttgcttcaaggagcctcccgaaaggagcaaatgcaccctggagcttctcatctgtcgttaaccttgaaaggccactgacnaataggttgggcgtggtgagcggtggcacgttggcgacctcggtggcgt

SEQ ID NO: 16579 - DNA, 520 bp, Zea mays
  Clone ID: LIB3279-231-Q6-N6-E3
gggcaaaacatgtgctacatttttaccctttcgaataataacgacaaactggtaaaaagggggaacataacagattaaccagacttatagccggggcgggggggcaaccggtaacgggcccaaaaccccggacaatgggggaaattaagctttcacagggggcttagctgggggtaagataaacgggaagcatgcgaggcgacccttaggcgaccccccccatcttggtttcaccagcggcgcccccaagccgggggctttcagcccctgccccaacagggccggccccctcggtgctcaaaccgggtttgggcctgcgggggttcccgttgcccaatgtgtttgggtcctcccggctgaatccgggggtctggggagcagcctccaaccgccgcctcccggggatccttggcgggcctggccttcttggccgcctcggcccgctgggggggctcctccctgaaaggggcccccggggggggcccccttggctttttgctccgcctgttgccccccctgc

SEQ ID NO: 16580 - DNA, 598 bp, Zea mays
  Clone ID: LIB3279-231-Q6-N6-E4
gccggcaagtaaaggcacgattcgaattacagtacaaatgaggcacatgacagaaggcccccagttgtaaaccacagcacgagatagcaaaaatcctagctgcctgagcaataatcgtgaagaaatccctcgtgatttgcgggagtctagacacgctgatattgctcgagatggatttacatgctacaaatttagtgtcacgagaaaatttaggttcagtacaatccttgttttgctccagggatggtcactgtgttgccgagcctcctcgaggcggcgggtgctgtggcggtggcggtgtaaggccaacattgcccattccctggtaagagcttagaccaggaatggatgtcatttgcccttgtggagccatttgtccctgaggccgattatacatgccacccataggaaaattttgtacgccagacgaacctgatgctccttggatgtttcccatcccacttgggaacccacccattgggggtacagtaccaggaggcacagaaccagcatgcatctgatttaggcccatcatgtgctgtggcatttggggcatcatctgactctgtgaaccatgcattgccgttgggtgaggcat

SEQ ID NO: 16581 - DNA, 406 bp, Zea mays
  Clone ID: LIB3279-231-Q6-N6-E5
cagttactgcaatgcaaaaggtagcgcattattcacaaccattaccatccaaatccaagcagctggatcctattttaggcttactgtccgattatatacagacaaaacataacttgccaaaccgggagacgtcacaaaccaactggttcaaataatagacacgaaagacatctcaaatctcaaattaagagaaagaagaaaagaaagtccagaaacaaccgccatacaggtcatgagtctaataacattagtgacctcaaatctcaaacaaaacaacagattagcagcgaactggcactaacaaccctgagcatctcactacagctgcttacacggtcaatgccatcatcgacctgcttcaactccccagcttgaacgcccagcgttcatcgccgaggagccttcc

SEQ ID NO: 16582 - DNA, 439 bp, Zea mays
  Clone ID: LIB3279-231-Q6-N6-E6
ggacataacaccaatccagctacacacgggtatattattgcttttgggccatgaacgagttgaacaaaacagggctccctccaactaggaattaaaacgcgttatatttctagggggaaaaaaaaaagggagggcactggaaggggaccattcttttgatacaaggggcaaaatttttaaaactggatctttttaaacttttggtcttgcacttggccttcgttcttggggcaagacctatgggttaaaaactcttcatgatccccaaacccttggatgactcgaaaaaaatttcccacgggacgtggccgaccagaatccaagcaccatccttggtttgggaaggggggaccacattattagggggggtggccggataaaccaatctccccttgttcatgctgttcccagatgcggggaaggggccaaacattttttt

SEQ ID NO: 16583 - DNA, 625 bp, Zea mays
  unsure (1)..(625): unsure at all n locations; Clone ID: LIB3279-231-Q6-N6-E7
ccgcggggcgatggcattgcttcccgaaagctaggtccaatggacagaaccatgactgctgcccagtatctgttttcaatctgacggacacgtcctcgatccgagatccgtattccatgttttctatctttggctcagagccggtatggcagttcttcggtacctacatctggtcttcgccatgttattacttcaactcatcagctgaggaattcggagatggccaatgcaactagaactagtacatcctagaaactccatactgaactgcattgaccttgttgtagccacctccaacagctgcaatgccactgaaaggggcgatcccatgaatcatgctagaatgcagagcggttctatctgcgggatcagcctttgggacaccttttggtatgtagtaggaagacctcaagtcaggggacatctgtgatactaccttggcgtccatgaaccgctgtgctggctggtactgcatgcggtccttttccagctcctgttggagctctctgtctgagttgtctgacttccggtggtaggcataggctgacatgttcgacgtggttggaggaagtactggattccttgagaccctacgttngctgtatggatcaactgcagctgcgtt

SEQ ID NO: 16584 - DNA, 634 bp, Zea mays
  Clone ID: LIB3279-231-Q6-N6-E8
aagggacaaattatcaggcatcatcaatcaggccattccaagctcgttgattagcaaactacaggcgttacatgaaaagaaaaatgtaccaacgatatcattcagacagcaatgcaacagacattgcacccaaatgtgcgttataccgtagcattccacagacattcaagtccccctatatatcgaaaccatcactctagcaaatccccaaacagaagttaaaaggtacccagctatgcctgggtagcattttttatgttgcagcaaaaaaggatacattccccgcttaagaggtcgattcagcttcctatttcccagctcggcgacagcaaaaccagagatcactcccacgctttaagggcaccacccctcccaattgccttgatgatagtctgcttactgttgcgcgcactgcactctctgggctccgcccggcatctcgtcgtcctcctcgtacgcctcctgggcagcgtgagcttgcttcctgcgcatctcttcctcgatgttgttcacatcatgcatagtcgtctcctcgcattcatctatctccatgtctgtcagcttggatgaaggccttggtggaagtactgtctcgagagctttgcactgctctggtgccagcgagtcagggaac

SEQ ID NO: 16585 - DNA, 544 bp, Zea mays
  Clone ID: LIB3279-231-Q6-N6-F10
gccacaacttcatcttaaaacaaggtttatgaacaaagacatgtttaaagtagccagcaaattcatggcgactattccaatccatttccacactcaaaagttgcaacaagtccaaggggaaaaagatgatccagacaatgataactcaagagagagtccaccctagaacaacttaaatcgtgcaaggcacaactcctgctcaagtccaagactcatgatcctttctactcaatcagatcatcatcgtcatcaggaagaggttgtgcagctgctgcagcaagctcggcttcatgctgctgctgcatagccatgtcgatggtaacttccggaggcttaagagcaacagcttcaacaaagtgaaggttcggatcaccagccagcttccttgcaaggtacaggaaaggtttctcaaagttgtagttgctcttggcagaaatttcatagtactgcagattcttcttcctgtggaaagtaacctgcttggctttgacctgcctgttcttcacatcaaccttattaccgcagaggacaatggggatgtttt

SEQ ID NO: 16586 - DNA, 193 bp, Zea mays
  Clone ID: LIB3279-231-Q6-N6-F11
agaaaaatgcccgactgacaaacgaagggcagactctatgaccataaatgtttttggggaccgatgtcaccacctagtaggatagttacgagtgtttggagatctaagtctccatccaaaacaaattgttggaagaatcctccctctacatgaattattaatttcttcgatatgaaaggcaaaaacttcacca

SEQ ID NO: 16587 - DNA, 533 bp, Zea mays
  Clone ID: LIB3279-231-Q6-N6-F2
actctcaaaagctcggtaaatttttactccagtcacagtcacaggatgcgctcccatcggaccgaaaacacagctcgcatcacgtacgaatgcatgcatatatatactacaccgcagtagttacaaaatggtagcgttgtcgctgagagctgcgttcctgccaccactgtttatcgtgatcgccatggccgggcttcgctgggatttggcctacctgccgcggaggagcgccttctcggcggtgtccatctcctcgaggatgcgcgcgcggcgcttggccgggatgggcgccgtggggccgaagctgatgtaatggcccgacacggcgttgagcgccgagttcatctcccggaacgacggccgccccagcagcgacttctcccgccggtgcttggccacccacgagttggacagctcccggagctccgccaccgggtccgccacgctcgggtccgacttgtccaggttgttcgttgtccgttctttccgagcacctctttcgtcttgctcacgtatttcctcgtccggcggac

SEQ ID NO: 16588 - DNA, 487 bp, Zea mays
  unsure (1)..(487): unsure at all n locations; Clone ID: LIB3279-231-Q6-N6-F3
gtggttttttttttttttttttttttttttttttcaagtcgaattatgttagcgaaacatctgttcgcctccacagaagcaagcaccaatgacataagagtggcccctaatggcctcaaatcataaagctcctacaagcccacacgggcgggggggggggggggtccttcttaaccctctctgggaaagttgaantgcgggggtctgacgaaaagcccggcggacctcagcgcccgggacctaaagccgcngaagaccnccactccnccccctcctttgggggctggggcgagccnncnccaccctcttcccccccatccccgnccgggccntcancnncttcntcccccccccccccatcgncttccccnnggccgnccccctcgccttcccccttctcttttttttcntcnncnncnncgccgccgccaccctccngncccncggggccccccccncccccccccccnnncccccgggacccccc

SEQ ID NO: 16589 - DNA, 342 bp, Zea mays
  Clone ID: LIB3279-231-Q6-N6-F4
acaaaaaccacacggtacattttcagattgcatagtgaaaatgcggtgtgcgaggtccatttccttcaccagtcactcgaaagcgagagagctcatcggtaagctaacctatccacctgaatagctgatcgtcctgccacgtggtctcgagggcaacatctggcagcatcgcgcgtggcagtggtgtcagtccaccagcagtacatccctctgaagttcttccccaacaaccgctgctgtgccctattcgtcctctgcacctgcaggtgcatatacgacggctgttctgctgggtgcatagaccgagaaagaacacggcctgttgtcatgcggccagtcagc

SEQ ID NO: 16590 - DNA, 619 bp, Zea mays
  Clone ID: LIB3279-231-Q6-N6-F5
aattaaaagtcagagctcttgacattataaaaaaacatttgacagaatacatggcatatcattctctctccccaccctttcatatacagtgacgtaaacacaccacgaaagctataatatcaggacaactagtttgttttcagaagtacaacccagtatagaggaccatgtcttattgaaaaccatatatgtagtattcattattcaagcacacaaatgactaaacaagtgtcgatctactatgctggtatttctgtcgagagtcatcctcggccgcaagctttaagcaatcccaagccgcttctttgtctgctcaagtaaaaactgtgggtcctgtttagtctgtgtgtatgcatcaatcttgtccacttcctcaatgaacttctgaaggttgggtctgccctttgtaatatcatagttctttatgttggaatagaatatctgaaacctctcgatgaatggtacatacgcaatgtccaccagactgaactgaccaagggagaatggaccctcgttgaatttcccgagggcgtcttctattttatccaaagcagcgacagcttcctcagacacatcttccttggagactatacaaaagtataatgctttgttaaatgca

SEQ ID NO: 16591 - DNA, 618 bp, Zea mays
  Clone ID: LIB3279-231-Q6-N6-F6
aggaaacagggattccactatatgctgttgatcctgtcatgagccgacatcagccagccggccataaagttgtacagtattcagttagtgcgacgggttgccttcaaataacaccgatgcgaggcaatctataaccagatgccaaaatttcaaaaaaaaaaaaaaaaactttttggtactatatatcgagaggatcagaaaaccctgcttctagtctggagctgctagagcattatatcgacttggggtaactgcggttggacctaaagctgcaagtggtgaaatggggattcagattattctaccagagaaatgcctagagcgaccagcatccccattgccagggagatcagctgagctactgagctcttgagggttgttttctggtcgttcatctgtggtaggactcccgcgacagcaatgtaaatgaaaccaccggcggtgaaaccctcaatcagggaggaatgtcccggatctttacccaaagacaatgctagtgctgttccagcaagagcaaccaacgcagagaggaaattgaagaataaggccttagataccgtgaagcctgaccgcacaaggataccaaaatctcctacctcttggggaagttcatgtgca

SEQ ID NO: 16592 - DNA, 600 bp, Zea mays
  Clone ID: LIB3279-231-Q6-N6-F7
aactattggattatttgcgctggattatataatctggagagattacaatctgaaacaaacaaggtctaagtcaaaccctggaaaactcaggcttgtgttgcgttcatttataagcaactacgcactagattctgtactgacatttgagagctatagattgcgaaatgtggatgaagcgtgtgccattgatccttatttctgagacgcgatagatcttgtccgacgatgtcgtcagacatcaagcggattctcttcggccgcctttggcttgctctccagaggccgcgcgcgcggcgcagcctcgagcagcagcttcacgacgatcctcatggacgggcggttgatcggcaggctggacgtgcagagaagcgcgacgtggagcgccctaaccatgtcgtccctgctggactcgccggcgagcctcgggtccagcaccgagtccacgccatccttctcgatgccggtgtgcacccaccgcaccaggtccttgtccccgagctccgccccgacgggcttcttgccggtgacgagttccagcatcaccacgccgaagctgtacacgtcgctcttctccgtgacgcgcagggtgtacgagtactc

SEQ ID NO: 16593 - DNA, 568 bp, Zea mays
  Clone ID: LIB3279-231-Q6-N6-F8
gcagccttaagatcatagatttactcgtttcagttgcatacagcatcagagtctaggaaaacgaacaaagggtcccacaattcaagcctaagggctcaacattgacaaatttattacgagaaagacaatacgacaatctgcttgttcacattgactccagatgcaaaagaccacatgcagcagaatgtatcactccaggatagggtctatttaagcatcagcaaaccccagttcggagagcttgaggtgggcctctttgtagtcatcaaagaaagccttctcatccgcagcatatttctcgacaagagggcggaaaacagggtcactcagcagggctttgtcacttgggagctgaagaaggccctccttatcaccactcagaagttccttgaagtaagagttgtcaaagaccaaagggtttgtagtccaggccccctcgaaaccagaccgctctttgtggcaccttcccaatgtgtggccaccagagagggcaacaatgtcctgatcgctcaagcccatctgcttgccaaaaacttgcctcaggtggtcagaacccttagtggcatca

SEQ ID NO: 16594 - DNA, 547 bp, Zea mays
  unsure (1)..(547): unsure at all n locations; Clone ID: LIB3279-231-Q6-N6-F9
tcgcgatctagaacctcacagcgagaagaggtttgctggtttcaagaaggatgacaagcagctggatgctgatatccatcgcaagtacatctatggtggccatgttgctgactacatgaggaacctcgctgaagaggagccagagaagtaccagtctcacttcagtgagtacattaagaagggaattgaggctgatgacatggaagctctgtacaagaaggtccatgctgccatccgtgctgatccttctgtggtcaagtcaaccaagcagccaccaaaggagcacaagaggtacaaccccaagaaactgacatacgagcagaggaaggccagtctcattgaaaggctcaaccaactcaactcctcgggcggcgcagatgacgacgatgaggatgacgagtaaagtttggtcccatcgaagtagtgctatcttatgcggcgatcagtatttgtgctatggcatttatcgctacctgtagtcgtgcaacatgcatttttgtttaagttgtncgatgcgaacaaagntgnttntgttngttgggagctg

SEQ ID NO: 16595 - DNA, 609 bp, Zea mays
  Clone ID: LIB3279-231-Q6-N6-G1
ggaatgtacagatatttaagtcgtgatgtcatatctcctccaaacagttctgaccgcgtactccagcttcctaccttttaccattatcatatggaagtaatggaacatgggaaagactgcggggattgaagtccactacattgcgataccgtgaccactgaaaacacaatttggttgaaagtctgtgcatatcaaacgcctgaaaagaaaaaaaaaaggcgagcaacttggtgtgctctaacatttgaatcccctgcagaccatcagccaaatgataaggatcagagccgcaatgccgccacccaccatcagcttaaacctcaggttctgaagccacatctttcgcctcaactctctgccatgcctgtggaagctgtccgcctgtgactgtagggtctctgtcttacccaccaaaagctcaatcttctccccgcgatccaatatcttctcaatgttgtccatcatgatccctttgacatccgataggtgggctttcaccttggagagcttgttaatttcctctggatgattaacacaatactgcatatggtccttcaacctcgggccgaattacggtcaaggttgtaggcaatgctgaaccggtcttcg

SEQ ID NO: 16596 - DNA, 549 bp, Zea mays
  Clone ID: LIB3279-231-Q6-N6-G10
aacacctcaattagcttgatttgttttgttttttccaaactgaactctatgagaaatgttttcatggagtaacttgttaaccgtatacaaaaattgaatcatcgaataacactcaaacgtaggagattacataacacttattggtataataacattacaattccgaaagtacaaccaaccagatacatatgtaaacgagcatcatctcatacacacagagagaacagatcagcagcaataatcatgtgttgttgagacgcagccaattcttcttgtctcgtttgccgaccagccccggctctgtcagtctgtctgcctcgtatggttggcgggggcaatcattcatcactcatcagtagcggagcatatgcggggcgcccatgggcatggcggcggccgggtagcagggcagctgccaggggcggagcagcgggtcgtccgccggcggcaccttctcctggatgtccatggcgacgccgctgaactcctcgacgacgcggagcaccttgttgacggagcggaggcgggcgcccagctcggcggcgcggg

SEQ ID NO: 16597 - DNA, 418 bp, Zea mays
  Clone ID: LIB3279-231-Q6-N6-G2
ggggggggaatttgggggggaagagggggggggggcccaaagtttttagggaaaaaagggggtttgggggcaaaaaaaaggggggggggggtcgggcaaaaggttgggttaaaaaaaaaagggggggggcccaaggggggggggggaaaaccttggggttaaagggtttggacccaaaggggggggggggggaaaaggggggttttttaatttccccccccaaaaagggggggttttccccggggggggtttttttggggggggggtgccccggggggccccgggcttcttttaaagaaaaatgggaaaatctttgggaaggttgggaaaacccaaaaagggggggcccgcgccttttttccctctttttttgttgggttttggagaacctcccccgaggggggggggcccttttttt

SEQ ID NO: 16598 - DNA, 585 bp, Zea mays
  unsure (1)..(585): unsure at all n locations; Clone ID: LIB3279-231-Q6-N6-G3
gaacacaataattacttaatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctntccgttntagcacgacaaaagtnaaaataaaacatcacgatgtggagtgaaactgaataattctagtccatggatataggctccttttttttgatcgccacggggccttgtgtagccgctccattgttgggtgaagcaccgtccattgtctcgagcgagctctccntcnctcgtcatcatcttcatcctcctcgcttccctcttcgtgctcctcgtcattgaccttcgtcttggacttgtcagactcctcttcgtcttcctcctcttcctccttggcgggagccttcttagctgccgtgctctcgcccttgttgtnggctgcgatggccttggtgncctctagcttgagcttggtagccttggcttccttgggagccctgtccgcctcgctcaggg

SEQ ID NO: 16599 - DNA, 501 bp, Zea mays
  Clone ID: LIB3279-231-Q6-N6-G4
cttctcaaacaaggactagattcaaacaaggcagtgtttttatttacagtctgtttttgtttcactttcttctcaacaactgcatatccctgagaaatgctgctacgcgaacaagactatctgactcatctaccaatcacaagagggaagggaaatacactgaccacatacttacagtagataactggtccaaaacgacaatgctcatcaaccacatatccatgcttttggttagacatgatatacttgtatttcccccatatattgcagaccctttctgaagtgcaaacctcaatcagcttaaagttgtgatcgagactaaatgcacagcatgacagaacccacatgcacaaatttgtattgttaagctgagttagtgaggtttaaacatcatatacaggcatgcgctcttcaattggcacacggcagattggacacttcttgcatttctcagcacaagatttgcataaagttctgtgccggcagggaagtagcaccatg

SEQ ID NO: 16600 - DNA, 604 bp, Zea mays
  Clone ID: LIB3279-231-Q6-N6-G5
catcaatggaacaatcaagtacatttatattccgttacaagaaataaatatgaataatccaagtattgcatacctgagaaacactaaacttcatcacaaataaatgatcagttctactgctagcacacttgtagatagttatctttttatagggaatttattgcacaattacttcataaaaaacaaatgatggcccctcagtccaatctgaaaccacaaatatatgacattgtcagtagtgaatttggaaatgttcacccgatatgaaattgtctaacacgaaacgccaaattggtgcaaacaaagagcccattactttgcttaactaggaacaccgtatttggaggataataatgatcctactaacgcctcgagatttgcattgatttgagacatttgaagatgagacattggagggaactaaatcttgtgctttgcgtgcagttggagacttggtttccgccaacgctcaccttcagcttccaaattcttcagacaggtctcatcttgctgcactgccacctacacatccgatcaaccgaacatgagaaaattggaggaaaccaagtattgccttttctttctcaatcaaatttggttccat

SEQ ID NO: 16601 - DNA, 83 bp, Zea mays
  Clone ID: LIB3279-231-Q6-N6-G8
ctctctctctctctctctctctctctctctctctctctctctctctctctctctctctctctctctctctctctctctctctc

SEQ ID NO: 16602 - DNA, 569 bp, Zea mays
  Clone ID: LIB3279-231-Q6-N6-G9
gcaaagtcctttgatgatgattacattgtatatcttggggatgacaccccaagtaccattgaagaggcatattcctctcctgatgctgacttttggaaggaagcaaaaaggagtgagatggattctattatgtctaatgcaacttgggaggtcgttgagcgtccttatgggtgtaagcccattgggagtaaatgggtgttcaaaaaaaaagcttaggcctgatggtactattgaaaggtacaaggcgaggattgtaattaaaggctattcacagaaagaaggggaggatttctttgatacttattcacctgtggctcgattgaccaaaatttgggtgctactttctctagctacctctcatgggcttctcgtccataaaatggatgttaaaaaaacattcctaaatggagagctagatgaggaaatctacatggagcaaccagctgagtttgtagcaaacggtcaaaaaggcatggtgtgtaagttattgaaatgtttacatggcctaaaacaaccacctaagatatggcatgaaaagttcgatagaactttcacatctaccggctttg

SEQ ID NO: 16603 - DNA, 509 bp, Zea mays
  Clone ID: LIB3279-231-Q6-N6-H1
aaaaaaaaaataataatgcattattaatactaggagtattctccttttttccatccggcggagggggtgctccactacacagcgatgattctagagcaaataatatttgcctatacaaactggaaattacctaggaacgcaagaaaatgatcaatccgatccggccagggaaacaaacaaatgaaagaattcctacctatattatctctctcttaatttctccattgcttcttttttctttctgggaaattcctgtctggcgctgcttgcttgctactcgtcggcgtctcccgcaaaaacaaaagccgccggcacatgggcgggggcgccaccaccaccttttttgtttggcccagcgccgcccttgctgccaccaggcctgatctgctcgagctgccgcaacaccttgtgcgcctccggcctgaccgcaggcgccgggtcgacccaatgcaacgcgagcttcaacgtgtccatgaactgctcgtccgcggccgtccccgcgggggggt

SEQ ID NO: 16604 - DNA, 553 bp, Zea mays
  Clone ID: LIB3279-231-Q6-N6-H10
ccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggcgcccgccaccgccgtagccgccgcctccacggccaccaccgtacccgccgccgccgccgcctccacggccgccgcgggactgggcctcgttgacggtgatgttgcggccgtccagctccttgccgttcatgccctcgatggcgttccgcatcgcctcctccgt

SEQ ID NO: 16605 - DNA, 613 bp, Zea mays
  unsure (1)..(613): unsure at all n locations; Clone ID: LIB3279-231-Q6-N6-H11
caaacagggcaaaaaagccaagtttagcgtttcctttagatagtttgttggaacccatgctttgtagatagcttcctttagctaagtgtgctctgtaaacttgagatttagctaggatttttatataagctcttggagatgctcttaacatacagtgggaagacggaagggtgtacaggtccaagtccaacacacgacacacacaaacacacgcgctgatggctgacgagtgacgacccacatgcatgcacataccgacatacgtacgcccaatccttcatcacaagagcggacaggcacacggcatgtacgtacagtacagagtacagacacgccttattacacgcgcacgcacgcatgcatccatggccatgcacagcgttgttcaagactcacgggacgccggcgccacctgctcctcctcctcctcctcctccgccaccgaggccgccgccgcctccgaacccgccgaacgggcccgcgccggcgacggccccgccgaacgggccgaacccagcgacgccgccgcccatcgggccgtggacgccgccgaagaggccgccgccgccggtccgnccaccgaacacgtcggcggtcttggcctgctcgtcgt

SEQ ID NO: 16606 - DNA, 534 bp, Zea mays
  unsure (1)..(534): unsure at all n locations; Clone ID: LIB3279-231-Q6-N6-H3
gcgggggggtttttttttttttaactgncctgggttctttttcttngttgccctcntggttcctctccccccctttcnnnncccnngtcgcgcccccttcnggggccccccccctgctgcnggnngccgcctttctcttctcccggncgggggggggggggggggntcnccctgccccccccccgcccccccnnccgtgggggggctcgctctccccccccccnnnttcctnggccgnctnccttcggctcccgccccccccccccngccggcttggccctccgccgggcccngcccctcgccctgccccccccgcngccgcccccccgcccccgtccgncttccttccggctctcccgggtccccccctcccgcctgctcgctgtcctctttttcttttttttctnntgcccccgccgcctctttcttttttccccgccgcccccccccgggcgcccccccccccggctcgccccccctccgcgcccccccctcgcnccgctcttccggcccgcctctcccgccctcgctcgt

SEQ ID NO: 16607 - DNA, 281 bp, Zea mays
  Clone ID: LIB3279-231-Q6-N6-H4
ccatattaactgctcactatgtaaaccggtaagcccactgttccaacacttctctatctacagctacagccacaaagctgataacactacgcaacaaagcaaatgtcatcaaagcgcttgagtacacaaattttattgcccttccggctcatttgattgtaaacttccatcggagctatgtttaccagactcgataaccagttgtctatcttggttctcaaacttggagccctgaagattttcagatggcttgcctgacaattccatttgtctctcattac

SEQ ID NO: 16608 - DNA, 613 bp, Zea mays
  Clone ID: LIB3279-231-Q6-N6-H5
gcgccgccgccgccgacgagggcggcgccgccgccggccttgctgccgcctccctccttgaggaacccgcgcacgaggcgcagcacgaggggcacgtccaggagcagcgccggcgcgtgctcgccgccgtggccgaacgccggtatcatcacggcgcccagcgtcgcctggtccagccgtctcgccgcgcgcgcctccaggtcccgcagcagcgccgcgtccgcgcccaccatgctccccgcgcggagcagcttcagcaggaagtcgcacgtgattccgtcgtcggcgacggccgcggccacggccgcggcggcgcagcagccgccgccgccgcccgccggcgggtccggagggagcgcggccacgagggactccaggaggagccgcttcttcagccacgtggccgtggggctctccggcggcaggaagcgccccgacgcggacgacgccgtgggaggcgccacgtccgggagccacttggcggcgtagtgcgacagcacggacgccagcatgtccggccgcgcgcacgacgcggccttggacttgacggcggccacggtgcgcgcgaagctgtccacgtcgttcacgcacgagtcgtcgctggcgctcgccg

SEQ ID NO: 16609 - DNA, 547 bp, Zea mays
  Clone ID: LIB3279-231-Q6-N6-H6
caaatgaatatcataatagcaaataactcgtgtatcaaagctagcagatgagaggctgaaacatcttcggatcaagcaaaccaactggaacaccgcgaaacacggaatacaagaggcaacattgtctcacagccacatatatcatatagtgaagcgcaacacagataagcagctgtcttatcgttctcttaggtgttttggagatgggtgggtgggcaatgctcatttctttccacttttcttgagacccgagcctccaattgcgcccttctgtgccttggccttcagctccttcagcgccttttcctcatcttttttcttctgcaaataagcaagatcactctcgtcgtactccttcttgtcgaccttgggcgccttcagcggcttggccttccctccttgcttcgacatggccggcgggggggacggatcggcgggcgagggccgaaaccctagactggacagcaccggcgtacggcaccgcgacggcgagtaggtggggagaggcaagcgggaccgggtgcgcgaggaggctggtgatatgcac

SEQ ID NO: 16610 - DNA, 225 bp, Zea mays
  Clone ID: LIB3279-231-Q6-N6-H8
cagtcgtaataagcagtttcaagtttactttcacggacagaaagcattctgctaaaacacacaccaactttcgtgcagacagcgagttacgaataagagctatgcagggaggattacagatccagacctagtaaatctatatcgcccaatttctggtaaccttgttcgctcgttactttctagcagttcttttcttcgtggtgcctctagcagttggtgtcgtat

SEQ ID NO: 16611 - DNA, 611 bp, Zea mays
  Clone ID: LIB3279-231-Q6-N6-H9
gatgaaataaatataattttccgtgctaaataatgaactagtagtggttttgtttggttacatgttggcataaaatgggtgatctacatgttgtttacacttcagaaagaaatgttgctaatgttttgaaccgttctaccatcgaaaccaccgatacttgtatgttctctccttcagttatgacttaaaagcaattgttacctcattgatatcattgtatttgcttaactgatgtgctgctacgcatgcaaccaaaatttctgaagctcaagcgcttgaagggacccacaatcttgcaatggaagcacttcagccaaacatccaggctgggatccatactcgtaacctcccagtaaaacagcttggagggatgatctttggttgcaagccttgggaaatggttatgtggtccatctatgctgattcctgtatgatctcatcctctctttgcttatactatttatctaacttgatgtcttctagcccattacaacttattgcttggaccttgagtcagctatgtttgtattctgattaacttggtgccttttatatatacttgcagcagcatatggtgtcatcctctgtataaaaattctgcttcatataat

SEQ ID NO: 16612 - DNA, 72 bp, Zea mays
  Clone ID: LIB3279-232-Q6-K6-A1
aatgatacagttttaatgctaaattagtttttttgtacaaaataactaatttagcattaaaactgtatcatt

SEQ ID NO: 16613 - DNA, 467 bp, Zea mays
  Clone ID: LIB3279-232-Q6-K6-A10
agagaagttactagtacaagttactcggggagtgggctctggcagggtgggtaagttgctgcaacgtgcgtgtcgtgcggggttaattcggtcccgcactctgcggtataaattacagttattaattaattagtccacggggaaggtgcgtgatcatcatatactgtatggatggatggaggggttcatcctacctgttggctggtcgacggatggctggatggacacgtgccgccaggcggatggatggggttcatgggaatgcaacgcacgatgctgtcctcatatcataatttttttttttttctttagtgtttctatgtgctattaattttaatagtagaagtactgtttcttagctttctatttctcttttctctgttcaatttcatccaaaagtgtacctacgtacgtactagctattgcatgatcgatgtggtcaatatattggttgtcatctcatgtgc

SEQ ID NO: 16614 - DNA, 556 bp, Zea mays
  Clone ID: LIB3279-232-Q6-K6-A11
gtccactttccccgtgcttctccgcgggggagggggcgtcccagtgcgaagagactccgactcagatggccagccgctgggtccggcccgaggtgtacccgctgttcgcggcgacgggcgtggccgtcggcatctgcgggtttcagctcttccggaacatcactggcaacccggaagtgggggtgaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcaatgataaaattgtcatttggat

SEQ ID NO: 16615 - DNA, 663 bp, Zea mays
  Clone ID: LIB3279-232-Q6-K6-A2
gaatattttcgccttgcaacgccagagatggagtatggcaggatgaacatcggaagcaggccatcgaaaagaaagccgagtgcgggcatcgagtcgctgcgcgcaatcccttggatcttcgcttggacgcagactcggttccacctgccggtgtggctgggtttcggcgcggcgttcaagcatgtcttggacaaggacatacggaatctccagacccttcaggagatgtacaaccagtggccgtttttcagggtgacgatagacctggtcgagatggtgttcgccaagggtgatcctggcatcgcggcgctgtacgacaagcttctggtttcagaggacctgtggccattaggggcgcgtctcagagccaactacgaagaaacaaagcagcttctcctgcaggtcgctgggcacaaggaccttctggagggcgacccgtacctgaagcagaggctgcgcatccgtgactcgtacaccacggcgctgaacgtttgccaggcctacacgctgaagcgcatcagggaccctggcttccaggtgaagccgcggccccacctgtcgaaggacatcatggacatgggcaagccggcgtcggagctcgtgaagctgaacaccaccagcgagtacgccccggggctggaggacaccctcatcctgaccatg

SEQ ID NO: 16616 - DNA, 659 bp, Zea mays
  Clone ID: LIB3279-232-Q6-K6-A3
aatgatttatttctggtgagttcggtgtcaaacttcgccttgatggtgttcaaaagaaatggggaaggccaacatattcttcttctacaccctcaagctcgatctctagtcaaccaacacccaatggggcctctcattctgatgggggagggtcaagttcgcaaccacgggagtcatcatacggttctaagagacagcagggcacggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccgatcccactctaggtgatgttaattcgatgggctcccgcaaggagcagctgcagtggcttcaatga

SEQ ID NO: 16617 - DNA, 615 bp, Zea mays
  Clone ID: LIB3279-232-Q6-K6-A4
gcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagccccctggcatcggcagcgcccaggaccccggcactggcgccgtccgccccgtcgtcttccttccagggcgcgtcaacggccagtacatcatcgagggactctcctccgggttcatgttcctccttggcggcattggcatcatcctcctcgacctcgccgtcgaccgcacgaggccccggagcctccgcgtctcgtttggaagcgccggcgcagtcgccgttgtcatcgcctacgccatggccatgctcttcctccgcatcaagatccccggctacctctggtgaggttgataaatcttgcctgttaactagaccagatccgtcgcgagatctcgctgcatctaaatagacctgcgtgct

SEQ ID NO: 16618 - DNA, 653 bp, Zea mays
  Clone ID: LIB3279-232-Q6-K6-A6
gtaaccacacaggtgaattaaggatatttgactgcaacacggcaaatctcctagagacccaaacatgccacctacatcttgttacaacgatggaggcgacatgttctggtggacacgagcttattctcacatccagcctaaatgaggttaagatctgggatgccttctcggtatctgcagggcctttgcacacatttgaggcctgcaaagctgctaggtttaaccactctggaacttcatttgctgccctttctactgatacagctcaacgggaggttcagttgtatgatgtgcagacatatactcttgctacacagcttcctgataacactagcagttcaggttcgggccggggttacatacaacccattatacatttcagtccttcagacacaatgttgctttggaatggagtcctgtgggatacaaggcagccaaattttgtacatcagtttgaccagttcacagattactgtggcggtggcttccatccggcaggaaacgaggtgatcttaaattcggaggtgtgggatctgaggaagttcaagcttttacggagtgtcccttccctggaccagacagtaataaagttcaacggcactggtgatgttatctatgccatcctgaggcgtaatcttgatgacgtgacatca

SEQ ID NO: 16619 - DNA, 573 bp, Zea mays
  Clone ID: LIB3279-232-Q6-K6-A7
cccacgcgttcgcacacgcagacacgcgtgcgcggggccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccagggggggccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggtttggcctgcgaattgcaaccagcaaagatgatattgaagttgtggctgtgaatgaccctttcattgatgctaagtacatggcctatatgttcaagtatgaatccactcatggcccgtttaa

SEQ ID NO: 16620 - DNA, 521 bp, Zea mays
  unsure (1)..(521): unsure at all n locations; Clone ID: LIB3279-232-Q6-K6-A9
gtcccaaagaatataccaagagacatgaaccttcaagagaaactgataataataaggtatgacctgtctgaatccttgttttatacatacatatgtgggttcctgggaagtttggaagcaccggaattcttgtttatttgaaggaactctgcctattatccatgcgctccttcagaccataggagatgagtgcagtttatggtgcatggctggagcatcaaagtttagtgaattactcgcaaggtcgttggtctagattgtctaatatatagagtagtttatttgatcagcagatcaggttctggtcatgtatagaaccactcaccccttcctttttcggttagggtgggtgtgtggtgtttgtttttcggcttgggtttctttctaactccagcatgtcttgtatttctctatcttaattaaatgtcacacagatctcctgcatagtccgagaaaaaaatatgggtgctttcatgcagaaacatcttttagatcaattcactggtcaaatgctgttggng

SEQ ID NO: 16621 - DNA, 570 bp, Zea mays
  Clone ID: LIB3279-232-Q6-K6-B1
gcggcagtctccacggacgaccgcgtcgactacggcttctgcgtgtcggagctgagcaagcaccgcgacagccctggcgcggacgcctggggcctggccaaggtggcggccaacctcggcgtcaacaacgccggcggcgcggtccgcgacgcggaggcgctgctggccggctcgccgggcgcgggcgcgggcgcggacggcgccaaggcgagggcggcgctggggcagtgccgcaggctctacttcgacatggagctcgcgctcgcgggcgcgtacgacgagatcgacgcgcgcgagtacgcggcggggaaggagatggccgtggagggcatcgcgttggcgcggcgctgcgacgccgtcttcgccgaggccgggatgccgtcgctgctcgcgcggcgcgcggagtacgcccagcagatcacggtcttgtgcattgccatcaccgacctcatcgagtgatggtgcgttcttcagttgtgtagcaaataataattggtacgatatgtgaagagtcaacaaggcgtgatttctttgaataacagtccaggtttctagaaattggttccttga

SEQ ID NO: 16622 - DNA, 609 bp, Zea mays
  Clone ID: LIB3279-232-Q6-K6-B11
ggaggaagatggcgtggaggaggatgaggaagaagaggatgaggacgaagatgatgaagaagaggaggaggttgaggatgaaggtgaagaggcggagccacagagcagtggtagggttgccatgatgacaggcgaggatgaaggagaagagatagatgggcatgaacatggagaaggggacgatgaggatgaaaatggtgagattggtgaagaggatgaggagggattggaggtggggaatgatgacgacgaagacgacgcagatgcggatgatgaggatgaagatactgaatatcttgtgcaaccaatcgctcagcctcaagccatggctattggaagtgaattagatggagttgaccctgatgatgctgacgaggacaaggaagaagtcgacaacgatgatgatggggccacagatcagccttcatcctcgcatggagccaagcggaagagagatgatgatgatctgtcaggcagtggtgatgacagtgaggatgacggtgttgaggacttgaggcccttcaagcacaagtgatggagcagccaatgtacatggatccctccctcccccttcttcagctagaaataagcagcaagatcagcaacagc

SEQ ID NO: 16623 - DNA, 606 bp, Zea mays
  unsure (1)..(606): unsure at all n locations; Clone ID: LIB3279-232-Q6-K6-B2
gtcgtcccacccagcagtgcagagactctctctctctctctccccggccacctctcgctcacgagcaccccatcttcccggccaggacctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctcctcctggcgctccgctcgctcaccttccagctctggttctcctacggcaacatgctcttcttcacccgccgccgccgcgtcgtcaaggacggcgtcgacttccgccagatcgacgccgagtgggactgggataacatggtgatcctgcaaaccctggtcgcggcggtggcgatgggcagcgcggcgttcccggccgtgtcggagctgcgggcgtgggacccgcgcgggtgggccctggccttgctcctgcacgtggccgtctcggagcccgtcttctactggacccacagggcgctgcaccggggcccgctcttcagccagtaccacgccaggcaccactcgtnccccgtcacgcaaccggtcac

SEQ ID NO: 16624 - DNA, 576 bp, Zea mays
  Clone ID: LIB3279-232-Q6-K6-B3
cggacgcttgggggcagcgctgcctgcttcttcttgctcacgcgaagggaaggggtagccgatctcggcccgcgttgatccggttgcgggggcttgtctctcgcttggtcctccaccgcgcggcgccgcaccgtgaatcgacgaccggccacgatgttcgtcaagaagctcgtggagagggcctccaagaagcaacatatcggcagcatcagctcccttcgccccgagaacgtcagcccgcggctagccttccactacggcgtccctgcggacgccgccctccttgcctacgaccccgttctccacgtgctcgccgtcgccaccaggaatggacagatcaagctgttcggccgcgacaacacgcaggcgttgctccagtccccctcccctctcccttccaggttcttgcagtttgccgagggccaaggggttctgcttaatgtcaatacccagaaccagatcgaggtttgggacattgatgcgaaaaaactctgttatctgcacccggctgaaaaggcgatcactgcattctctgtgctgcagaagaccttctacatatatgttggagatagttct

SEQ ID NO: 16625 - DNA, 563 bp, Zea mays
  Clone ID: LIB3279-232-Q6-K6-B4
cccacgcgtccgctcagatggaacctttgcaagggcagctgttcccagtggagcatcaactggtgtatatgaagctctggagttgagggatggtggctctgactatttggggaagggtgtctccaaggctgtgaacaatgtgaattctgttattggacctgctctgattggcaaggaccctacagcacagactgagattgataacttcatggttcaacaacttgatgggaccaaaaatgagtggggatggtgcaagcaaaagcttggtgctaatgcgattctggctgtgtcattagctgtttgcaaagctggggctagcatcaagaggattcctttataccagcacattgccaacctagctgggaacaagcagttagtgttgcctgtccctgcattcaatgtcatcaacggtggttcccatgctggaaacaagcttgctatgcaggagtttatgatccttcctactggagctgcctcatttaaggaggctatgaagatgggtgttgaagtttatcaccacctgaagtccgttatcaaaaagaagtatgggcaagatgccacga

SEQ ID NO: 16626 - DNA, 653 bp, Zea mays
  Clone ID: LIB3279-232-Q6-K6-B5
cccacgcgtccggtccaggataaccaaaatgtgttgtctgttgataaatttgtattgcttgtgctggaatccgcaagggttgaagtggcagtcttgctaaatgagcttgcttatctgaagtacgagtcatcaagaatttctcagacagatgaagccatcagtcagaaacagaggaacctggctatactattttcgttaatagaaagaataattaaaatgatatcaaatgccagtagtggtgaaggtgcaccaattcataccatccgtgaaagtaccataatgcaggccattacgggattaaatgagacaatcaatttagtcttagactttctgcaggacgcgaaggatcatggtcaatggaaaggtgacgatcttttagcagctgcaagaatagtaggaagttatctggcagaagcaccatatgcctgcaaggagaagactgggaatctattggaatttatcttttctatagaaggtcaagatgaatcaagttccttctattctatttgcttcatgcttccaatgctatcccaaataacaatggaggttgatggatgtagaactttggcatcatttggtggccataaggcagttatagattgccttgttaaaatgactgagcagggtggaatgacgattgataacggtagcat

SEQ ID NO: 16627 - DNA, 648 bp, Zea mays
  Clone ID: LIB3279-232-Q6-K6-B6
atttcttctctctctgctcctccgcctccgcctgatccatccaagacagggatcgccatgtcggactcggaggagcaccacttcgaatcgaaggccgacgctggggcgtccaagacctacccgcagcaggctggcaccgtccgtaagaacggcttcatcgtcatcaagaaccgtccctgcaaggttgtggaggtttctacctccaagactggtaagcatggccacgccaaatgccactttgtcgccatagacatattcaatgggaaaaagcttgaagatattgttccttcatcacacaactgtgacattccgcatgtgaaccgtactgagtatcagctgattgatatttctgaggatggatttgtgagccttcttacttcagatggcaacactaaggatgatcttagactcccaactgatgagactcttgtggcccagattaaggaagggttcgaaagcgggaaggatcttgttgtgactgtccagtctgcgatgggggaggagcagatctgcgcgttgaaggatgttggccccaagtaacttccttggctttggagacggaaccctactgtatctcaacttaaatcggaaaagaagtgtatcaccaaaggattgctaccgagacattcacctggcttgagctggctt

SEQ ID NO: 16628 - DNA, 503 bp, Zea mays
  Clone ID: LIB3279-232-Q6-K6-B7
gcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtg

SEQ ID NO: 16629 - DNA, 609 bp, Zea mays
  Clone ID: LIB3279-232-Q6-K6-B8
ccgccagctactcgttcggctgcggcgccgcgtgggccgagcacgcgcagagccagcgcgtggcgccgtggaacgcgcccgacccaggcggcgggagcactggcggctacctgctcaacgtgtcgcagcaggcggcgcttggcggccagagccagttcttctcccagaggggaccccttcagtccagtaaccagccctccgagcgaggatggccggagaccgtcgaagccgacaacccgatgcagcagcagcatggcgggccgaccatcgggttcgcgcccggtaccggcttctccgggatccgcatccccaccaggatacagggcggcgaggagcacaacggcggcagcggcaatggcgacaagccgccgccgccgtctgtttcctcggcttctcgccagtgacagcagcagtggagcacagattactccatccaaccagcatgaccattgatcagtgcagcgtgtatcactaaaatctcacacgccagctcctcagcgtgcacccttgttgcgagagtctctctcgtgattcttcttcgttgtagcactgcattttcccacgacaggattgccgtttcttgtactactgagtttctggtgcagttat

SEQ ID NO: 16630 - DNA, 626 bp, Zea mays
  unsure (1)..(626): unsure at all n locations; Clone ID: LIB3279-232-Q6-K6-B9
cccacgcgtccgtctccacctccctactagtagtactcttcggtgcagtccgcatccccacatctgaccgactctcaaagttcacagctccaatcctggtgcaagcgcacagtagcggagcaagatgcggggaggagaccggccatcggcgtcgctccagctcctctcgctgggcctcgtgctcctctacttcttcacctcaggcagcaccgttggtctcgtggagggacagaagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactactgaggaggagtgtgaggaggagtggagagacgaggagaggagagagatccattcgtgcctggcggtggcggctccactgcatctgtatgcagagtcttggttntctagtctcgactgccaatttaccanatgcaca

SEQ ID NO: 16631 - DNA, 324 bp, Zea mays
  Clone ID: LIB3279-232-Q6-K6-C1
gcagaagcagaagtcggcgttgcgggaggcgtacaagaagaagaacctgctccccctcgacctccgccctaagaagacccgtgccatccgccgccgtctgaccaagcaccagctttctctgaagacggagagggaaaagaagcgtgagaagtacttccccatgaggaagtatgctatcaaggcataggtcagaactgtgagatgctgtgctttgcatatcatcggctgtgttttaatttttggtttgtatggacatttgttgtggctcggaagtacgatgtattcctctgttgccttataaatggctagattggtttgactggc

SEQ ID NO: 16632 - DNA, 549 bp, Zea mays
  Clone ID: LIB3279-232-Q6-K6-C10
cctccctatcgtgcgtctcctctcgccggctttaaaaacgcacacaagcgctaaaaccctctccaccgtccacctcagctcccatatcctttcccctacctctccagcatctcccgtctccgtcgtctcgtctccgctcctcacctcgccagccatgggcaagatcaagatcggaatcaacgggttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaggttgttatctctgccccaagcaagatgcacccatg

SEQ ID NO: 16633 - DNA, 628 bp, Zea mays
  unsure (1)..(628): unsure at all n locations; Clone ID: LIB3279-232-Q6-K6-C11
cagaaacacagatgggcgacggggctccgccgccaggggctctatactccttcggaacgccgtggccggagctcaatcaaggcctcacctacaccgacacgttccgttgcgctgatgcggacgccgctaccaccttgattgagttctactctactaaccacaagagctcggcgccattggcggggtggatcaagaggattcgtaatgggcagataaccgttgatggtgaagttgtcactgatccagatatgactctggtggatgggtctaagttggtatatcatcgttttccttggcaggagccatttgcgccgtatttgctggaagtgctctacgaggatgatgacatggttgcccttaataagccttctggcttgcaagttctgcctaaaggactgtttcagcagcgaactgttttagcacagcttcaattgaaagactggaagatggcctcatcttgccggttcaagagaaaagatgtgcagtcacatccagtacctgttcatcgtttagggaggggaacatcaggcctcctgctttgtgccaagacaaaagttgccaaagttcgacttgcatcttattttgctgaaggtgctataaatgctgcaaagaanagggataaatcaga

SEQ ID NO: 16634 - DNA, 579 bp, Zea mays
  Clone ID: LIB3279-232-Q6-K6-C2
cccacgcgtccggtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgagggtcctatctgtggtgtgccagacttcaagatgaggggaaagaagagtgatgagctcgaacctgtcgatgctggcgatgaagatgatgatggtggtgacgatggggacgaggatggtgactttggggaggagggtgaagaggacgtctcagaaggggagggatatgacaacccaaagggcaatgagaccaagaagcaaagaggtgatcctgaggaaaatggtgaggaagatgaggaagaaccagaagatcaggagggtggcggcgacgacgacgacgatgacgatgatgagaacggggatgacgaggacgacgacaatggggatgacgatgaggagggtgt

SEQ ID NO: 16635 - DNA, 563 bp, Zea mays
  Clone ID: LIB3279-232-Q6-K6-C3
tgaagctctgtccaaaagaggtattctgacactgaagtacccaattgagcacggcattgtcggcaactgggatgacatggagaagatctggcaccacaccttctacaatgagcttcgtgtggcacctgaggagcaccctatactgctgaccgaggctcctctgaaccccaaggcaaacagggagaagatgacccagattatgttcgagacattcaactgcccagcaatgtatgtggccatccaggctgttctttccctgtacgccagtggtcgaacaacgggtattgtgctcgactctggtgatggtgtgagccacaccgtccctatctacgaagggtacacgcttcctcatgctattcttcgattggaccttgctggtcgtgaccttaccgacaacctgatgaagatccttactgagaggggttactccttcactacgactgccgagcgagaaattgtcagggacatcaaggaaaaacttgcctacgttgcccttgattatgaacaggagctggagactgccaggaccagctctagtgttgagaagagctacgagctggccg

SEQ ID NO: 16636 - DNA, 632 bp, Zea mays
  unsure (1)..(632): unsure at all n locations; Clone ID: LIB3279-232-Q6-K6-C4
gttgcggtgcacagtgatgcttggttgctggctgtggccttttacttcggtgcaagatttggttttgacaaagaatccaggaagcgcctttttgtcatgattaataacctccctacaatatatgaagttgtcacgggaactgccaagaagcaaaccaaggagaaaactcccaaaagcagcagcaagagcaataaagctggcccaaaaccgccacgccagccagaacccaactcaaggggttcgaagatgccacctccgaaggatgaggatgacagcggaggcgaggaagaggaggaagaggaagatcacgaaaacacgctgtgtggttcttgtggtgacaactacggacaggatgagttctggatatgctgtgatgcgtgcgagacttggttccatggcaagtgtgtcaagatcactcctgccaaggccgaacacatcaagcactacaagtgtccgaactgcagcggtagtggcaagagagcccgagcatgatgatgctggctggatatatccatctctcatgcctgacttgatgtaaaacgcccacatggggaccgaatgcccgatggctgttgctttcagtgtangaccagctgtgtaggttcttgatgtgctgtttgctgtagtatgtc

SEQ ID NO: 16637 - DNA, 426 bp, Zea mays
  Clone ID: LIB3279-232-Q6-K6-C5
cgtgaacccgccgccgacgcagcagcaggagacgcgccaaggagagcccgcaaggaggcgactatgagggccaagtggaagaagaagcgcatgaggaggctgaagaggaagcgccgaaagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagtaattgcaatgttcgtct

SEQ ID NO: 16638 - DNA, 660 bp, Zea mays
  Clone ID: LIB3279-232-Q6-K6-C6
cccacgcgtccggcagagaatccccaagcaaacaaacagggtagagggagaggagaggagaggagaggagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttggtcaggttccagctctgcaggatggtgacttgtacctcttcgaatcacgagcaatctgcaagtacgctgctcgcaaaaacaagccagagctgttgagggaaggaaacctcgaggaggcagcaatggtggatgtttggatcgaggtggaggctaaccagtacaccgctgcactgaatcccatcctcttccaggtcctcatcagtcctatgcttgggggaaccaccgaccagaaagttgtggatgagaaccttgagaagctgaagaaggtgctagaggtgtacgaggcacgcctgaccaagtgcaagtaccttgctggagacttcctcagcctcgccgacctgaaccatgtgtctgtcactctctgcctgttcgctacgccctacgcatctgtgctcgacgcctacccgcatgtga

SEQ ID NO: 16639 - DNA, 593 bp, Zea mays
  unsure (1)..(593): unsure at all n locations; Clone ID: LIB3279-232-Q6-K6-C8
ggattgctgacaaagctcaagtttacacgcagcatgcatacatgagaccccttggagtagttgctatggtcttgggctacgatgaagagaaaaatgcccaactactcaaatgcgaccctgctggtcacttctttggacataaggcaactagtgccgggctcaaggagcaggaagcaataaattttctggagaagaaaatgaaggatgacccgaaattcacctatgacgaaactgtgcagattgcaatatctgcgttgcaatcagttctccaggaagatttcaaggccactgagatcgaagttggtgttgtgagaaaagatgaccgcgttttcagagctctcacgacagaggagatcgatcagcacctgacggcaattagtgaacgtgactgagatgtcatatgctgcacatttcagcgctgcatacactgcgccgtgccattgtgcttcggcagtcattaagtttcatagtcatcaaaggaactgagtgtaccatntcacgtctaagacccgaaacaagccccctctcgatgtacttcgttcataatcgtctgggggttgattgatttggcacgggttggttttggggttgtt

SEQ ID NO: 16640 - DNA, 656 bp, Zea mays
  Clone ID: LIB3279-232-Q6-K6-C9
cggacgcgtgggcccgcacaaatctctcctcccctcttgccctcgccgcattgcccgccgacgacccccccggcccccgccggatagagaggaggaggagcggcgcggctgcgggagagccgggcggcggcggcggcggcggagcgggcttcatgtgcgacctagtggcccgcacgggccggcatcagcagcggtacgaggatggccgtcggctagtggccggatgcataccatttaggtatagagctaacaatgatgaaacctctggtgacaaaactaagaaactcgtggaagttctcatgataaattcccaaagcggacctggtcttttgtttccaaagggaggatgggagaatgatgaaactgttgaagaggcagcagctcgagaagctatagaagaagctggagttcgaggtgatatagtgcattttctggggctctatgacttcaaaagcaagacgcatcaagatgcgtgctgccctgagggtatgtgcagagctgcagtgtttgcgctgcatgtaaaggaagagctggcctcatggcctgagcagagcacccgacagaggacctggctcacggtccctgaagctgcatcaagttgccgataccagtggatgcaagaggccttgctgacaggcttctctgactggcacgac

SEQ ID NO: 16641 - DNA, 673 bp, Zea mays
  Clone ID: LIB3279-232-Q6-K6-D1
gccaattgtggccactttcagtgggcacctggaaagtctaaagagaagagctctaaagagaaacgtctgtgacttcatttttctcccaggaatccaggacattttgcttccaatgagtctggtacatcaccttgtcccagcatactgatgacgtggcgatgtatttgtggagaggtaagctgatcaagggcctgtttgggaggtctggctctgactggctccttgctctagtaaccggaggggccacaaaacgtgtcttcaccagctccccattgttttgaaaaggacagaaaacaacttcatgaacattgcagccacagtgccatggataagctacagtagcgcatcagctggaacagccaagagctgtcccaaacgtggcctgaacaagcacttctctcaggcaggtacatattctaatcctgtaattagttggttgacactaacatgcagccttccgttggttggctaacaactaagggcttgttcggttagctctcaatccatacgtacggattgagtaggattgggtgcgtttaaattccaagcaagtcaaacttctttttaattttttctaatctctcagggatcttctcagaagttatttatttttccgcctggtttagcgtattcaaattcttaatagacaagtcacaagtggccatcagtggag

SEQ ID NO: 16642 - DNA, 651 bp, Zea mays
  Clone ID: LIB3279-232-Q6-K6-D10
gcagagcaggatgaaatggttaaagagcaccgcaagcggaaagagtttgaagtttttgttggtggtctggataaagatgcaacagaaaatgaccttaagaaggtttttggtgaagttggtgagatcactgaagttcgtctgatgatgaaccctgccacaaagaagaataaaggctttgccttgctgcgatatgcaactgtagagcaagcaaggcgtgctgtttcagagctaaagaatccactggtgcggggtaaacaatgtggtgttgctccaagtcatgacaatgatacactctttgtcggcaatatctgcaaaacatggacaaaagaacatttgaaggataaactgaagagttatggagttgaaagttttgacgacttactactggttgaggatacaaacaatcctgggatgaatcgtggctatgccttgcttgagttttctactcgacctgaggcaatggatgctttcaggatattgcagaagagggatgtagtctttggagttgatcgtagtgcaaaggtttcctttgctgattcctaccctcaagttgatgacgaaataatggcacaggtcagaacagtatttcttgatggccttcctccctcatgggatgaagaccctgttaagaaatatctcaaaaagtatgga

SEQ ID NO: 16643 - DNA, 404 bp, Zea mays
  Clone ID: LIB3279-232-Q6-K6-D11
cggacgcgtgggtgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccggaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccatagctttgcgtgccgg

SEQ ID NO: 16644 - DNA, 578 bp, Zea mays
  Clone ID: LIB3279-232-Q6-K6-D2
cccacacgtccgcttgcagctctgctcgccgctctctatcgttctccctatcatacgcagctcgtccagatgtcgtacgaggcgtcgaaggtagcggtgctggagtcgctgctccgcaagcggcagcgcgaggaacagtggaccaccgagaagatagagaaggccctaatctacaagaagaggtccatgcagagccgcacgctcatcttgacccgcgcaaagcagtacgccgaggaatacgatgcccaggagaaggaactgctgcaggttaagcgcgaggcccgtttgtatggtggtttctatgtcaatcctgacgcaaagctgctctttgtggtcctcatccggattattaacgccatgcacactatgaccaggatgatcttgcagcttctgctattgaagcatatcttcaatggtgtgttcctcacagttatcaacgtgactattaacatgctacgcaatgttgagtcatatgtcgcatatgggtacacaaacttgaagagtgtctacgagatgatctacaagaggctctatagacagctgatcaatctgaggatccctctgtccaacaaccaagt

SEQ ID NO: 16645 - DNA, 659 bp, Zea mays
  Clone ID: LIB3279-232-Q6-K6-D4
aatctccagtcgattatcaaggagcaagagatgtaaagccaatcgtagagtttgctctgtcacaggtcaaggcccttcttagagataggttgagtggtaaggcatcagcagggtcaaatggcaagacatctggaggttcaagtgagaaaaatgaaccaagtgcatcagtagaattaaattcgcgtaacttcgatgaactcgttgtcaaaagcaaggacatttggattgtggaattctttgcgccatggtgtgggcactgcaagaaattggcacctgaatggaaaaaggctgcgaagaacttgaagggccaagtgaagctaggccatgttgattgtgatgctgaaaagtccttgatgagcaagtacaaggtggaaggttttccaactattttggtatttggtgctgataaggagagcccgttcccctaccagggggctagagttgcatctgccattgaatcctttgcattggagcagttggaagccaactctggcccagttgaagtttctgagttgactggcccggatgtcatggaagaaaagtgtgcttctgctgccatttgttttgtatcattccttccagacatcctcgattcaaaggcagagggaagaaacaagtaccttgagctcctgctctcggttgctgagaagtataaaaag

SEQ ID NO: 16646 - DNA, 656 bp, Zea mays
  unsure (1)..(656): unsure at all n locations; Clone ID: LIB3279-232-Q6-K6-D5
gttggcagtggaaacacacatcatcctaattcacaggtgaccattgacagtaggagcatgtgttgcctcagttttgaggctggcattggtagttggagtaaagatgatccaagttcttggtttcccattggcactgggagtacagatcactccaattttcaagttactgttggcactgggagcacacaataccccagctcccaggttcccactggcattgggagcgcatatcaatctgattttcatgtcacattgggtgacagaagcgcaagtatccccgattctcaggctactgttcactatgggattaaacatcaacccaattcctgtgtcagtgttggcaacgggagcacaggtagcgtcaattctcaggatattgttggacacggaagcacatataaccctgaatctctgcctgccattggcgacgggagcatgcataacaccaattttgaggtcgtggtaggagttgggagcacagacaagggcaattcacaggacacccttgttgatgggaacctgaatcgccccagttctatggtttctgttgacaacggaagctcctgttaccccaattgtaaggatgctgttggngatacgtgtgctccatcctctgaaggctctaatccagaatatgcatcctgcactgaagtagt

SEQ ID NO: 16647 - DNA, 568 bp, Zea mays
  unsure (1)..(568): unsure at all n locations; Clone ID: LIB3279-232-Q6-K6-D7
gccacaccgctctcgtcctccgncgaagatgcctgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgccgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgagacgctcaggctcaacgagggcgtcgacgtcgatgggcccgaggagggcgaggagaacggcgactacaactacatccagttcgaggacgaggacatcgacaagatctaagaattctgtctctccttccttccggcacattttattattattatgggattccttttcgccttccggctaatttaatattatgtgacttgcgttntagt

SEQ ID NO: 16648 - DNA, 666 bp, Zea mays
  Clone ID: LIB3279-232-Q6-K6-D8
cgcccctccttttaccttctcccattcacgccccgtctctttcgtggccttccttttccggcggccacaagtgggcgagcggcggcgcccttcaccaggtcttcgtcgggcccttcaccggcgacgagcatccaccagaaacgtggagctcagagcattggtgcctctttcctctttcaccaaggattccggtgccttatttcacaagacaaaaaaagtctcaagggtcttgattcttgtatgaactcaagatttatggtggatcttggagctgtgggatgctaagcctggtctagctactagattatgaactctctgctgatctaatagcatttctacaagaattcttttgctggaaggtttattagttatttgcaacaatgaaggaacatctaatgcttaatattgatgacctaagcattcttgagcctaacgaggtcattgggacagtcaagaataaatcatctggggaaaccattgcacatccaccctccatggctcatgccattttagcagtgggagaaagcatggtttctgaagcggaacctcttctgcaagtggtggagtgtcgcatttgtcaggaggaagatagtatcaaaaatttagagagtccatgtgcttgcactggcagtctaaagtatgctcataggacttgtgtacaacgat

SEQ ID NO: 16649 - DNA, 665 bp, Zea mays
  unsure (1)..(665): unsure at all n locations; Clone ID: LIB3279-232-Q6-K6-D9
ggaaagaggaaggagctctcaccgcaggacgctgcattgctcatccagatgacctacagggctcaccttgctcatcgctcccaggtgcttcgctgcctgcgtgacctagctgtggctaaagccaagctcaaggagctcaggtccctgttctataacatctcctacaggcaccgcattgcgcatgaccacgaagagcgccagaggttctctgagaagatcatcgtgctgctcatcaccgtagatgcgctcgagggacctgactacatggtgaggaccgcgaagaaatctatgctagaggagctcgaagcaatgctggaggttgtggaccctcagcccccagggaagcagcgatcactgagccgcaggaaatttgatctcccagagggtggagccatccccgatgagaaaaccgctgctgtgaacaaagccatcaggatcatcgaggaaggcaagtgaagtgatgcaccaccaccttgttactggcaggattgaatcctgatgaaagctccatatctatccgtgtatcgtctaggagaagtttatatccgtgtgctttgctgacactcgagggaggagaactaatatctgcactttattgtaccttaaatgatagccatgtttntattgtgaacctgtagtatgttgctaggcagtcagtttgaaca

SEQ ID NO: 16650 - DNA, 653 bp, Zea mays
  unsure (1)..(653): unsure at all n locations; Clone ID: LIB3279-232-Q6-K6-E1
aaacaaactctttgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctcccccggatccgccattcccccgtgccctctctccgtcccctcaaccttctccctcctttcttgcttccctcaacaatcgccaaataacagcactagcggcagcggtagaggatcttttcgaggtaagctaggccggccggttccctgcgggaaaaagaaaagaaaaggaacctgtcttgatgtcgtcgtcgtcgctgtctccgacggcggggaggacgtccgggtcggacggcgactcggcggcggacacgcacaggcgcgagaaacgccggctgtcgaaccgcgagtcggcgcggcggtcccggctccggaagcagcagcacctgnacgagctggtgcaggaggtggcgcgcctgcaggccgacaacgcgcgcgtggcgggccgcgccgccgacatcgcgtnccagtacaccccggtcgagcaagagaaca

SEQ ID NO: 16651 - DNA, 658 bp, Zea mays
  Clone ID: LIB3279-232-Q6-K6-E10
gagaaatcccccaaccaaaccaaaccctcgccgtgccgccgcctccgactcctgctccgtccgagcctaccaccacagggcaagggcttcatccagccgcgtgcgagcctgaccgcccagttagacgatgagccgcagcctcggtatcccggtgaagctgctgcatgaggcggcgggccacgtcgtcacggtcgagctcaagaccggcgaggtctaccgcggctccatggtcgagtgcgaggacaactggaactgccagctcgaaaacatcaccttcacggcaaaggacggcaaggtgtcgcagctggagcacgtcttcatcagggggagcagggtcaggttcatgattatacccgacatgctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccctctgtgaggaggtagatctgtcgcgctatgtggcaaatcaagcttttgccctagttgcaaaaactttgcttgagcagcgatgctatatgggtgttaagggtagcttatcagcagcagttcatgtttacagcatagatgcaggacttt

SEQ ID NO: 16652 - DNA, 660 bp, Zea mays
  Clone ID: LIB3279-232-Q6-K6-E11
cagagatctgcatctccccgaagaagagctacagcgcgctcgaagaagatctatatcccctcgaagatcctcacacaagaggagggaatcaccaagaaggggagactcacctaggaggaggcactcacctaggaggagggagtcaccaaggaagagagactcaccaaggaggagagactcacgagggaggagggattcaccaaagaggaggagggactccccaaggaggagggataggtcaaaatcaaggtcaccttcaagaaaacatgacacttctagacataaaaaagaacatgacagatctcggtccaggtctccccactcaagggatcatcacagacgatctccaaggcattcaccaagacgcagatcacccccagccagtcatcgccatcattcaccaagaagacattggtcaccacctgccaacaggaagactggattgggtaagcctggaaagaatctctttattgcaggatttagctatgccaccactgagcgagatttggagaagaaattttgcaagtttggacgtgtaacaagtgcacgtgttgttcgtgataaacgaactggagattcccgtggctttggattcttatccttggataaggatgaggatgctgatgcagcaatccgtgcttgtgacgagactgagtggaa

SEQ ID NO: 16653 - DNA, 632 bp, Zea mays
  Clone ID: LIB3279-232-Q6-K6-E2
cttcggtcttcccaaacccccaacatccatgatccatctcatcgacaccccctccgctctccttatcccttccattcgcccaaacccccgccgccgtgacccctgccagcccgcggccttcccctcgttctaggcttcaactgccggcctcgtgtcttctgggcaagtgaagagagagatggcgtcgccaataccgcgcgagtgggtcgggctgcagcagtttcctccggccacccagaccgagctgcacgagctcctcggcaagctcaaggaggaggatgtgagcacattgacaattctggtgatggggaaaggcggagtggggaagtcatctactgttaactccatcgtcggggagaggatcgccactgtcagcgctttccagtctgagggtctgagaccgatgatgtggtcgcgcacaagggcagggttcaccttgaacattatcgacactcctgggcttattgaaggtggatacattaatgagcaggctgttgacatcattaagagatttcttctgggcaagactattgatgttctcctgtatgtggatcgtttggatgcgtacagaatggatacacttgatggacaggttataagagccatcaccaattcatttggaaaagatattt

SEQ ID NO: 16654 - DNA, 649 bp, Zea mays
  Clone ID: LIB3279-232-Q6-K6-E3
atttctcccaggataaatcatggcgtgttcgttatatggtcgccaatcaattatatgagctctgtgaggctgttggccctgagcctacaagagctgatttggtgcctgcctatgttcgcctccttcgtgataatgaggctgaagtgcggatagcagctgctggaaaagtaactaagttttgccgcatattaaatcctcagctctcagtccaacatattcttccatgcgttaaggaattgtcatcagattcatcccagcatgttcgttcagctttagcctcagtgattatgggaatggctcctgtactgggaaaggatgctaccattgaacagcttgttccaattttcctctctttgttgaaagacgaatttcctgatgttcgacttaacataatcagcaaacttgatcaagttaatcaggttattggaattgacttgctatctcaatcactgctaccagcaattgtagaacttgcagaggataggcactggagagtccggcttgcaataattgagtacatcccattgttggcgagtcaattaggtgttgggtttttcgatgacaagctgggggcgctctgcatgcaatggttggaagacaaggtcttttcaatcagagatgctgccgctaacaacttgaagcgccttgc

SEQ ID NO: 16655 - DNA, 260 bp, Zea mays
  Clone ID: LIB3279-232-Q6-K6-E4
ggcctacctcgtcggcctcttcgaggacaccaacctctgcgccatccacgccaagcgcgtcaccatcatgcccaaggacattcagctcgcccgccgcatccgcggggagcgcgcttaggcgtttacggttgattgtcactactgtagatgtttaggctatgttctcgccatgtcctaggtctgctttgttcttatttgtttttttggtttcatcctgtgcgttgatggttgtcaatgagctatcggtgcctgtctgagag

SEQ ID NO: 16656 - DNA, 652 bp, Zea mays
  Clone ID: LIB3279-232-Q6-K6-E5
gcgcacagtagcggagcaagatgcggggaggagaccggccatcggcgtcgctccagctcctctcgctgggcctcgtgctcctctacttcttcacctcaggcagcaccgttggtctcgtggagggacaggtacggcctttggctcttgacgctctatctatctataagacgtggtgcatcgcgaagccgtcggcgtcgaacgagatcctggcgcagaacctggactacgcgtgctcccaggtgagctgcgccgtgatccagaagggcgggccgtgctactacccggacagccccgtgtcccgcgccgccgtcgccatgaacctctactacgcctacagcggcaggcacccctggaactgctacttcaacaactccgcgctcgtcgtgcagtccgacccaagctatggctcctgcacatactactgaggaggagtgtgaggaggagtggagagacgaggagaggagagagatccattcgtgcctggcggtggcggctccactgcatctgtatgcagagtcttggttttctagtctcgactgccaatttaccaaatgcacattgttgtgttgtgttgtgttgtgtagccgtgctgcagctgacatttcgcagcgaactcgtggatactccgtttcgcattcatgtgctttgaagt

SEQ ID NO: 16657 - DNA, 653 bp, Zea mays
  Clone ID: LIB3279-232-Q6-K6-E6
caaacctccgaggattacaggttctatgccatttcagccgaataccctgagttcagcaacaaggataagaccctggtgctgcagttctctgtgaagcacgagcagaagcttgactgcggtggtggctacgtcaagttgctgggtggtgatgtagaccagaagaaatttggtggagacacatcttacagcattatgtttggaccagatatctgtgggtacagcaccaagaaggttcacactatcctgaccaaggatggcaagaaccacttgatcaagaaggatgtgccttgtgagactgatcagttgactcatgtttacactttgatcatccgtcctgatgcaacatacagcattctcattgataatgaagagaagcaaactggcagcatctacgagcactgggatattcttccccctaagaaaatcaaggacccagaggctaagaagcctgaggactgggatgacaaggagtacattcctgaccctgaggacaagaagccagagggctatgatgatattcccaaggaaattcctgaccctgatgctaagaagcctgaggactgggacgatgaggaagatggtgaatggactgcccctaccattcccaacccagatacaagggaccatggaaacaaaagaaaatcaagaacccg

SEQ ID NO: 16658 - DNA, 112 bp, Zea mays
  Clone ID: LIB3279-232-Q6-K6-E7
gatactctgtccaggacacgtacttagatgactgatgtgatgacgtagacgatgttatacacaaggtcttagaatacggaactgaaacgcgaactaagcagctggcaaccct

SEQ ID NO: 16659 - DNA, 575 bp, Zea mays
  unsure (1)..(575): unsure at all n locations; Clone ID: LIB3279-232-Q6-K6-E8
atcacaggtatatacaccgagagatgtaccttaatgagaaactgagagtctgtaggtgtagctctgccagctgccttggtttatacatacttatcgagcacccctggngacgagatgctagctcccgactaattgcttatcggaaagaactatgtctataatgcatgcgctccatcagatgatacgatatgagtgcattctatggcacatggctggcgcattagaggttatgaataacttacatggctcttggtctagatagtttaatatctagacaacgatgatgatgatcgatataatgatgttcttgacgtagatgaacaccataacgtgttgactactttgataccagcatcagtgtatataaagtttcatgatgttgaatgctatataactccatgatctataccatagctgtatattgaaatagtgcctgacaaatgtactgcataggtgaaaccaaccataggtgtgcttactttcttaaacatgtctaaaagcaactgactagacttgcgctgctgggaagacaagttcaagccaaacatggacaaggaaaaagatccgatgtcagg

SEQ ID NO: 16660 - DNA, 645 bp, Zea mays
  Clone ID: LIB3279-232-Q6-K6-E9
atttcgccccttccccaggaagcacatgtcgcccctccaggagtcttgttggaaacacaccgtcccatagaggccgtgctgttcagaatcagccatcaactggatttgcacctatcgtggagcctccagagtcctccgttgctatgctggtctcaatgggctttgatggcaataacgcaaggcaggcactcgtgagggctagaaatgacatcaacgtggcaacgaacatcctactggaagcacagtctcattgaactaacgcactgcaactttctggtggtaaattagagggaagaactggttatattccaagatgaacaaacaatatgagcacattggactacagatcggtagattagtgcctcatttcatctaccttgaactgcaggccgacagtttagtaaatcagcgtatacatttgcggcagttagttttatcgtgtcaatacttagatgccttacacacagagaatgtaatattccaatttcagcttgtaggatagatgatataagcattcatagtgtacaattcatccgatgttttacagctttagaacttgttccagcacgatatgtggatcgtgctgagttccttgatgttgcaaagaaaacgaggaaggacatcagggatcggtaaaatgtaagc

SEQ ID NO: 16661 - DNA, 589 bp, Zea mays
  Clone ID: LIB3279-232-Q6-K6-F1
cccacgcgtccgcggacgcgtggggctgatcgtggcagtggcggcggcggaggaggaggaggaggcgactacgccagcttcggtggccgcggtggctcctccttcggcggcggctttggcgctgctggctctgacgtccgccctggtgactggtactgctcctgcggcgcgcacaacttcgccagccgctccagctgcttcaagtgctccgcctacaaggaggaggccgctgtgaacagtggcgctggcggctttgacggcgacatgtcacgctcacggggctacggcttcggcagcggtgctgctggtgctggtgctggcgctgcccgtactaccaaccgccccggttggaagtccggagactggatctgcaccagatccggatgcaacgagcacaacttcgccagcaggatggagtgcttcaggtgcaacgcaccgcgggactctggtagcgctgccatgacctacgaaaactacttgcactgaggtgtaggatcgagcaagttaaaaagtctgcagcgccgaagaaagcgacgacaagaggagtcctcatcacgtcgtaacgtaagagagagagtagtggatttgc

SEQ ID NO: 16662 - DNA, 604 bp, Zea mays
  unsure (1)..(604): unsure at all n locations; Clone ID: LIB3279-232-Q6-K6-F10
gtcagagcagctgaagcttaatggacatgaaaggtcaaaaaaagcagtaggctggtgacattaaaagcttagacgaaagggaggagttgcttcagcaaatcaggagcaagaccttcaatttaagacgcacaaacgcatctaaggcagatggctcatcacaatctacagccagttccaacgttgcggcaattttggagaaagccaacgctatccggcaggctgtggccagtgatgagggtggcgatgatgatacatggagtgatatatgaccacctaattgcagacgtgcatggtagtcttttcttgtatattaagctattacaagatgaagtgattaaatgtgaataccatccttttcttcattgtaattagattttgcaggtcttgttttgtacctttcttagttcatattagtgaatcctaccgtaggtcgctgtggtcgtggaaatgtcagagcatttccacattatgtaaatgcatctttattatttatttatgatagtgagaacagctgaatagctgataaaaataagcatactaatctatctttttatcattgtattgattntttttgcaatgataataatatggagcatgatgttgc

SEQ ID NO: 16663 - DNA, 664 bp, Zea mays
  unsure (1)..(664): unsure at all n locations; Clone ID: LIB3279-232-Q6-K6-F11
tcgcccacgcgtccggaagaagtggacatcgaagagaagtatgctccggtacctgaatacccattggtggggttctatctaactggttatctggtagaaggattttttggatcttctctgcaacaaaggcaagccccggtgcatttgccacattccttgtatttataaaattttatcacttatatgatgcattagatgatagcagttgattgattaaacacttgatgcattaccattccttgaaagaattgagtaccataccttgtcacctgttttataaaagctagagatgcttaatcatgcgaatagattaaaaaaatgtttttgatctatgactcataatttacaaaagaaaatcggcttgggataatgaagacatcatctgcagtgagaaattcattatccaggcatggcccctctgtcaggtgtcaaatgttttgagaaatagcagaagtaaacttgaggctggggggttgacttgcaccagaacggagtctggttgtagtgtctccgtctgtatcgattaaggactgtaccgattgtaggcatgttgatctaggactttntagctggccacatacctcgtcatgggtaagcctgaacccggctattccatacgtgaaaggacaaccgcgcactgggcgtgggagatggtgggagtagc

SEQ ID NO: 16664 - DNA, 630 bp, Zea mays
  Clone ID: LIB3279-232-Q6-K6-F3
cggacgcgtgggggggccaggggtttcttcaggggatgggtgcctactttgcttggttacagtgctcagggggcttgcaagtttggcttctatgagttctttaagaagtattactcggacattgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacattgccggtgtcttctgtgctattgtttctcacccggctgacaaccttgtgtctttcctgaacaatgccaagggagctacagtgggagatgctgttaagaagcttggtctctggggtcttttcactagaggacttcctcttcgtatc

SEQ ID NO: 16665 - DNA, 540 bp, Zea mays
  Clone ID: LIB3279-232-Q6-K6-F4
tcagattgaggtccttaggaagaagggccactcttactcagagataattaacgagagcctgatcgagtccgtggactcgttgaacccgttcatgcatgctcgcggtgtggccttcatggtcgataactgctccacaactgctcgtttgggatctaggaaatgggcaccacgcttcgattacatcttgacccaacaggcgtttgtgactgttgacaagaaagcaccgatcaaccaagacctcatcagcaacttcatgtctgaccctgtgcacggtgccatcgaagtctgtgctcagctgaggcccaccgttgacatctcagtgaccgctgatgcagatttcgtgcgcccagagcttcgacagtcttcataagcttgtatggatccgcagtgtgactgcaatggctagtttgtaagaacttaatatgcctgggcttttgaactcttagattgtgcttgtattgctcgtgcttgaggaccagaaaattaaactcttggcggtgtggtactgttgtgatttgcaagaataaaaataattggttt

SEQ ID NO: 16666 - DNA, 595 bp, Zea mays
  Clone ID: LIB3279-232-Q6-K6-F5
cccacgcgtccgcccacgcgtccgccgcgcgcgcggcggccggcggcgagccctcacccatccgagcaagccgaggaggaagcgagcgcgcgaaagtatcaggaggaggcatgggtaccctggggcgcgcgatcttcacggtgggcaagtggatccggggcacggggcaggccatggaccgcctcggatccaccatccagggcggcctccgcgtcgaggaacaggtttcaaggcatcgtacaatcatgaatatttttgagaaagagccaaggatccatagagatgtgtttgttgctcccagtgcagcagtcattggggatgttgagattggtcatggatcgtcaatctggtacggatccatattgagaggtgatgtcaacagcattcatattggatctggtactaatatacaagacaattcccttgtacatgtttcaaaagctaacattagcgggaaggtcctcccaaccataattggaagcaacgtgacagtgggtcacagtgctgtattacatgcatgtaccattgaggatgaagcttttgttggtatgggtgccactctgcttgatggagtggtggttgaaaagcacagcat

SEQ ID NO: 16667 - DNA, 648 bp, Zea mays
  Clone ID: LIB3279-232-Q6-K6-F6
ctgctaccgccgaatgtgttccttccatccgggaagttatcgctaatggcattagcgtcaacgtcacgcttattttctctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaagcttggcattgactggggcgaggtcggaaagcagcttgagctggaagggtgtggactccttcaagaagagctttgacagcctactcgtgagccta

SEQ ID NO: 16668 - DNA, 658 bp, Zea mays
  unsure (1)..(658): unsure at all n locations; Clone ID: LIB3279-232-Q6-K6-F9
ggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttagggatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcctatccagagttggcggtgcagactatggctaagatctgcctgcaagcagagtcttgcgtagaccatgctgctattttcaaatcaatcatggcttcagctccaattccaatgagtccattggagagccttgcatcatcagctgttcgcacagcaaactctgccagggcagcacttatcttggtcctgaccagnggaggaactactgctaggcttgtagccaagtat

SEQ ID NO: 16669 - DNA, 620 bp, Zea mays
  Clone ID: LIB3279-232-Q6-K6-G1
ccagcagggagctgctcctctctccctcacctctgcaactcggtgcgtcctctgctcctccacctgcagctcgccccatctcctcctccaccatgcgtccagttctgtcccaccatggccgcccctcctccatctcctccctccctagcaggtgcccaggttccatggtcgcgcgccctagcatccgctcgcccctgcgcgcgctcctcccccatggcgagctcgccctcaactccctgccatggagctcgccccatgttctggacgctagccctcctttttctttctggtggccgaactcctccccacaacaacaacaacaccttcatccatggtgcccagctgctccttggagtctatggtgatgatctctatatccctttgttgttttagtggttcttgtgcatataggttcttattaataccatgctgatgtgatgttttatgtgtgtttatgtgtgcgatatggagtaaaaatccctggagaattaagtggagaagaaggttaagttcaacgcttcttaggtgttcgatgatataccccaaccagggatcatcgctgtgtctatgggtgccgaatcaaaattttcgttatggtacgttaattgatcgcacgatgt

SEQ ID NO: 16670 - DNA, 663 bp, Zea mays
  unsure (1)..(663): unsure at all n locations; Clone ID: LIB3279-232-Q6-K6-G10
ctttctggagcagctagggttccgtgctgggggcgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccggccatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaatatcaagaatgacttcacccctgaggaggaagaggagatccgcanggagaaccagtgggccttcgagtaaggaggtgctggatctattgatgcctaagtttgggggtgtctactactatgtctac

SEQ ID NO: 16671 - DNA, 640 bp, Zea mays
  unsure (1)..(640): unsure at all n locations; Clone ID: LIB3279-232-Q6-K6-G11
caactgtttgctttggattggcggcttcaatgggtgcatttttacttgctgctgggacaaagggtaagaggtactgcatgccaaatgcgaggattatgatccatcagccatcaggtggcgctggcgggaaagtcacagagatgggactacagataagagagatgatgtacgaaaagattaagatcaataaaataatgtcgagaattactggaaaatctgaggagcagattgatgaagacacgaagtttgattatttcatgagtccttcggaagccaaggattatgggatagttgacaatatcatagatgaggggaaaccagggttggtagctcccttggcaggatctgttccgcctcccaaatcgcgtgtgtggtacttgtggaaggcttcggggccgaccaggaagatcatgaaacatctaccttcagaggagaaactaattcacaatggtaacggaagtgcaactggagatgatggaaagctcaaggaggcaacggcaacttgaagacattttaggtgataaatagtaggtcgataatagaatggcttagtgcattacctgtattttaaatcattgtttgaatacagattattggaggatgttaatacagtgcagtattntggatgctgcgttttcat

SEQ ID NO: 16672 - DNA, 535 bp, Zea mays
  unsure (1)..(535): unsure at all n locations; Clone ID: LIB3279-232-Q6-K6-G2
cgcatcctctcatcagcttccttccacattcgtctcgagatctcgccccgtcgccatggacgcgatcgacagcgtggtggatcccctccgcgacttcgccaaggacagcgtccgcctcgtcaagcgctgccacaagcccgaccgcaaggagttcaccaaggtggcggcgcggacggcgatcgggttcgtcgtcatgggcttcgtcggcttcttcgttaagctcatcttcatccccatcaacaacatcatcgtcggttccggctaggcttacaggagtacagggcgactagcatgggagtagtgcaatacttttgggagcaatagataacgaggatcctggtctttcgaatagtattgttaatgaaatttttcgttcggttgtgtttctgatgtaatcgttgtactgagtagaccttctggataccggattctgagtagacctttgaatccttgatggatcagccaatctcggaaaggaagtttcgtattttgttgttccgttaagctgtttgctgtttgctctcaaaaaanaaaa

SEQ ID NO: 16673 - DNA, 652 bp, Zea mays
  Clone ID: LIB3279-232-Q6-K6-G3
cccacgcgtccgcccacgcgtccggcctaccatggtggtgacggatgacggagaggtcgagatcccgtccgcttgaagactagccatccaaggggacttccattggtgctgctgaagtgttgttgttctgcatgctatcgatgtacctttttcaagcaacgcgagccatctattttttttgtctagctatgttagtgatatcttgtgagagacctcaatgttaccaccgtatctttgtctttgttggatggagagatttaagcacctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaatttaaaaaaaaaaaaaagggggggcccttttaaaagacccaattttaactcccgggggttggaaaaaaaaatttttttttttggggccccaaaattaaattaaagggcccggtttttaaaaccggggaaggggaaaaacccgggggttcccaaattaaaaggctttggaaaaaatcccctttttcccaggtgggaaaaaaagaaaaaggcccccccccgtccccttttcaaaaatttggccccccttattgggaaatggacccccccct

SEQ ID NO: 16674 - DNA, 663 bp, Zea mays
  unsure (1)..(663): unsure at all n locations; Clone ID: LIB3279-232-Q6-K6-G4
aaaaaagaaagagagggggagagacacagaggcctcactccacacactgtcttgtctctcagtcccagagctttcttggatcgcgaggaatccactggaaattttgcaattgtagtagagaactgtatcgtccgacgaaggtgcatggtgttggccatgggtcacggcagggaacagagacgagcaggtcggcgctctccccccagctcattgatcctgtcctcgctataaggtagtcctgcggtggcctccgaatttcactcgatcgaacacgacatgaagcggccacgcggcgccagtccccctctggctgcgatgaccaatccgaacgatgatggttacggcgtggtcgggatggaggcggacgcagacgcggacgcggacgaggagatgatggcgtgcggcggcggcggggagaagaagcggcgcctgagctccgagcaggtgcgcgcgctggagcggagcttcgaggtggagaacaagctggagccggagcgcaaggtgcggctggcgcgcgacctcggcctgcagccgcgccaggtcgccgtctggttccagaaccgccgcgcccgctggaagaccaagcagctggagcgcgactactccgcgctccgncaggcctacgacgcgctgcggcacgaccacgacccgctgcgccgcgac

SEQ ID NO: 16675 - DNA, 665 bp, Zea mays
  Clone ID: LIB3279-232-Q6-K6-G5
ctgctaccgccgaatgtgttccttccatccgggaagttatcgctaatggcattagcgtcaacgtcacgcttattttctctattgcgacatacgaggctgtgattgatgcttaccttgatgggctagaggcttcgggcttgagcgacttatctcgagttaccagtgtcgcatccttctttgtcagccgagtcgacacccttatcgacaaaatgcttgaaaagattggaacacctgaggcacttgccttgagagggaaggctgccgtcgcacaggccaaactagcaaatcggctctaccagaagaaattctctggcccgaggtgggaggcgttggccaagaaaggtgccaagaaacagaggttgttgtgggcatccaccggtgtcaagaacccagcttatcccgacactctttacatcgacagtctcattggacctgacacggtcaacacgatgcccgaccaagctttgcacgcattcatagaccacggcactgtctcgaggacagttgatgcgaatgtgtccgaggcggaaggtgtatacagcgccttggagaagcttggcattgactggggcgaggtcggaaagcagcttgagctggaaaggtgtggactccttcaagaagagctttgacagcctactcgtgagcctacaggagaagggcaacag

SEQ ID NO: 16676 - DNA, 649 bp, Zea mays
  Clone ID: LIB3279-232-Q6-K6-G6
atcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttctttggatctg

SEQ ID NO: 16677 - DNA, 661 bp, Zea mays
  Clone ID: LIB3279-232-Q6-K6-G7
cccacgcgtccgcccacgcgtccgcttcccctccgagcctcagttcgcatccacgcgcgccgccgccgcctcgacgctcaccgcgcagccatggcggaacagactgagaaggctttcctcaagcagccaaaggttttcctcagctcaaagaaatccggcaagggtaagaagcctggcaagggcggcaaccgattctggaagagcattggccttggcttcaagactcccagggaagcaattgaagggacctacattgacaagaaatgcccattcactggaactgtttctatcagaggcagaattattgctgggacatgccacagtgctaagatgaacagaactatcattgttcgcaggaactacctccactttgtaaagaaataccagaggtatgagaagaggcactccaacattcctgctcacatctccccatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgatgtctttttaattcaaaagaaatctctcttctaggctggtgcttttcgactat

SEQ ID NO: 16678 - DNA, 660 bp, Zea mays
  Clone ID: LIB3279-232-Q6-K6-G8
cccacgcgtccgccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcatcgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactagagagaatttttgtaccttcagcagttcaaacgagctggcaaacttatctgaatctttttgataattggctagttcttctgttctggtgttatgaactcatgt

SEQ ID NO: 16679 - DNA, 659 bp, Zea mays
  Clone ID: LIB3279-232-Q6-K6-G9
gttctggagaatgttagaagtgtcttaaaacatggtggccgtgttctttttcgggactatgccttcggtgaccttgcacaggaaagactgatgtcaaagggccagcaaataagtgagaacttctatgtcagaggtgatggtacgcgtgcatattacttttcaaatgaatatctggtggatttattttcaaaatgtggacttactcttgaggagatatgtgtgcacaacaagcaagttgaaaaccgttcactggcgctggtgatgaacaggaattgggtccaagctaccttcaccctaaattcagctagtcctcaaggtccaaatggtcaacacgatctccttgcttacgaaggagaggatgataaggtagttactgacacatctaagaagaaaagcagctgtgaagaaatcgatctttctgaagatttttgcaacatgtttgggacatcacacagccttgatgaggtacaaatcattgcggtgaaagcaaaaggccacgacttcaaaataagaatgctcaggaaggaataccagcacacctgcagatcaactggcttaatgctctgggaatctgctcaattcatgtgctgtcttttagcagagaacccttcgatcgttgcaagcaaaagggtcctggagttgggctgtggctcagctgg

SEQ ID NO: 16680 - DNA, 557 bp, Zea mays
  Clone ID: LIB3279-232-Q6-K6-H1
cccacgcgtccggccagccattggttggtagcaagccaagctaatcaagttagctttagatacccgctcccgctcttcttccctccgacgaaggcagctgacgacacagcaggctagcttcggagttcggagcactcagccatggccattgccggcgctctcctcctcctgctcggactcctcgcgcgggaggccgctgccggcgggtggcagagcgcgcacgccacgttctacggcggcggggacgcgtccggcacaatgggcggcgcttgcgggtacggcaacctgtacagcacggggtacggcacgagcacggcggcgctgagcacggcgctgttcaacgacggcgcggcgtgcgggtcctgctacgagctgcggtgcgacaacgacgggcggtggtgcctgccgggcaccatcaccgtcacggccaccaacttctgcccgcccaactacggcctccccagcgacgacggcggctggtgcaacccgccgcgcccgcacttcgacatggccgagccggccttcctccgcatcgcgcagtaccgcgccggcatcgt

SEQ ID NO: 16681 - DNA, 507 bp, Zea mays
  unsure (1)..(507): unsure at all n locations; Clone ID: LIB3279-232-Q6-K6-H10
gtccccaattatttggcctccgtcagagaggggagaaagacccgttcgaggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccatttttttttctgcaatgaagagatgctggcaagcatactacctgcnnna

SEQ ID NO: 16682 - DNA, 658 bp, Zea mays
  Clone ID: LIB3279-232-Q6-K6-H11
gcttgttctgttattcctaatacacatggattgggtgggattggaaaaaattgagaagaagtttgacttgtttgggattcaaacccatccaatctcactcaatccacatggattgagagctaaccgaacaagcccttaaagtgacaataattcccaaactgtctaaatgcttcgctcccggggtattccaactgatcaattcatttagaaacaacctcttagtcaaactaatggaagggctcactccatcaaaaacagccctattacgagagagccataagcaccaagctccaaggataatgacactattgaaacccctcctcttgcacctatgcactcttttagagaccttttcccaccacacagcaaatgactgttcagcagcaataggagtgaggttaccaagcccgatagacgacaaaatgagatgacaaaaatccctagaaaaactgcaggtgcagaggatatgctggattgtttcctgctcctgatcacatagggggcaactcgccgggtaatgtaaccctctcctctgaagtctgtccgcagtccaatatttattccttatagccagccaaagaaaaaacttgcatttagggggggggcccaagtcttccacaatcgtttccaatgctcaaaggaaatggaccccaggaag

SEQ ID NO: 16683 - DNA, 581 bp, Zea mays
  Clone ID: LIB3279-232-Q6-K6-H2
cggacgcgtggggttggcggggaacgcagcgcgggacaacaagaagaaccggatcatcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctaactgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaactgtgaaggcaggtgagagggtgggatctgtgaatcactaggtgttgtttgaataagattgcaagatgtgtaaaaattggtttgggcttc

SEQ ID NO: 16684 - DNA, 638 bp, Zea mays
  Clone ID: LIB3279-232-Q6-K6-H3
catcccagtcctagcgacaccaaccagctcgccagcgaccatggggaacccggagaagctgatgaatcagatcttcgacctcaagttcacctccaagtcgctgcagcggcaggcgcgcaagtgcgagaaggaggagaaggagcagaagctcaaggtcaagaaggcgatcgagaagggcaacatggacggcgcccgcatctacgccgagaacgccatccgcaagcgcaccgagcacatgaactacctccgcctcgcctctcgcctcgacgccgtcgtggcccgcctcgacacgcaggccaagatgcaggtcatcggcaagtccatgcagtccatcgtcaagtcgctcgactcctcgctcgccaccgggaacctccagaagatgtccgagaccatggacaatttcgagcgccagttcgtcaacatggaggtccaggccgagttcatggagggcgccatggccggctccacctccctctccacgccggagaccgaggtcaacagcctcatgcagcaggtcgcggacgactacgggctcgaggtctccgtcggtctgccgcaggcagcccgccacgccatccctgccgccaaggataaggagaaagtcgacgaggatgacctttctcggcgcctcgccgagc

SEQ ID NO: 16685 - DNA, 587 bp, Zea mays
  Clone ID: LIB3279-232-Q6-K6-H4
cggacgcgtgggtacaaaggtcacacacgaggagtgaatgctattagattcacacccgatgggcggtgggttgtggtctgggtggcgaagataatatagtaaagctctgggatcttaccagctggaaagttattacatgaattcaagtgtcatgagggtcagatccagtgcatagattttcatccccatgagttcctcctggcaacaggttcagctgataaaactgtcaagttctgggatttggagacatttgagttgattggatctaccaggacctgagacgacaggtgttcggtccatgacattcaatcctgacggaagaactctgttatgtgggttgcacgaaagcttaaaggttttctcctgggagccaataagatgccatgatactgtggatgtgggatggtctagacttgctgatttgaatgtccacgagggaaaacttcttggttgttctttcatcaaagttgtgttggatatgggttggtgatctgacgcgtcttgagtcatatgcaacgggtacttcaacaaaattaaatggccattctgaattgaagactgtgtctagtggcactatgcctttacaa

SEQ ID NO: 16686 - DNA, 170 bp, Zea mays
  Clone ID: LIB3279-232-Q6-K6-H5
cggacgcgtgggcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatg

SEQ ID NO: 16687 - DNA, 585 bp, Zea mays
  Clone ID: LIB3279-232-Q6-K6-H6
ctcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaagtcttagaaagtagggacttcatttgcactgtgtgctgtagcatgctcgtgtctagatctgtggatgggatgtgtcctgctctagtttcg

SEQ ID NO: 16688 - DNA, 605 bp, Zea mays
  Clone ID: LIB3279-232-Q6-K6-H7
cagaggtgggctggcttctcctccgggggttacgcgagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctactgcggcggtcgcggcggcggcggctatggtggcgggcgccgtgactgcggttatggcggcggtggcggctacggcggtcggcgcgagggtggtggcggcggctactgaggcggtggcggctactgcggtcggcgcgagggtggtggtggcggctactgcggcggccgcggcggctggagggactgatgtgtgggcccatcctggcttcggccgagttatcttatctatctatagtat

SEQ ID NO: 16689 - DNA, 609 bp, Zea mays
  Clone ID: LIB3279-232-Q6-K6-H8
gccctccgctgcccgctcgcctccggggccgagaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccgggggccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaggtcacaattacaagcaaaagagatcctgcagag

SEQ ID NO: 16690 - DNA, 669 bp, Zea mays
  Clone ID: LIB3279-232-Q6-K6-H9
ctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttggtaaaagactgatgattcgtgttggcaaacgaaa

SEQ ID NO: 16691 - DNA, 466 bp, Zea mays
  Clone ID: LIB3279-232-Q6-N6-A10
gcacatgagatgacaaccaatatattgaccacatcgatcatgcaatagctagtacgtacgtaggtacacttttggatgaaattgaacagagaaaagagaaatagaaagctaagaaacagtacttctactattaaaattaatagcacatagaaacactaaagaaaaaaaaaaaattatgatatgaggacagcatcgtgcgttgcattcccatgaaccccatccatccgcctggggggacgtgtccatccagccatccgtcgaccagccaacaggtaggatgaaccgatcaatccatccatacagtatatgatgatcacgcaccttccccgtggactaattaattaataactgtaatttataccgcagagtgcgggaccgaattaaccccgcacgacacgcacgttgcagcaacttacccaccctgccagagcccagtgaaagagtaacttgtactagtaacttctct

SEQ ID NO: 16692 - DNA, 555 bp, Zea mays
  unsure (1)..(555): unsure at all n locations; Clone ID: LIB3279-232-Q6-N6-A11
atccaaatgacaattttatcactgaagtgcggcaaatccagatgacagatgaatatgaacatcaagcatggacgatcaaactcatccaccatcatacatataccaagtcatcaccaagcgctcaaagtacttttagaggtcatggatgtccccaacatattgagttgccagcaaagtgtaaaatccccagtagcaagtagtagtagtagtatgccaatcaacatgcttcacttagggtcagtgaagaacttgttaactgcaggcatgatctcaggagtcttgtcgtgcacaaagcttcttaggccatgcatggcgtaacgtctcccctcctcatggttctcaagcacaccagctgccctccctgccttgtttaccctgacttccgggttgccagtgatgttccggaagagctgaaacccgcagatgccgacggccacgcccgtcgccgcgaacagcgggtacacctcgggccggacccagcggctggccatctgagtcggagtctcttcgcactgggacgcggcctcnacggcggagaagccggggaaagtggac

SEQ ID NO: 16693 - DNA, 554 bp, Zea mays
  Clone ID: LIB3279-232-Q6-N6-A2
cgagggcaacagggtgtaactaatccccacatatccaggcgttcagcggttcacgccatatgatatgagatcccctacagaaagaagaaggcacactggcttcagcccgtgttctgcatcccggcagcgatgcccttcatggtcaggatgagggtgtcctccagccccggggcgtactcgctgggggggttcagcttcacgagctccgacgccggcttgcccatgtccatgatgtccttcgacagggggggccgcggtttcacctggaagccagggtccctgatgcgcttcagcgtgtaggcctggcaaacgttcagcgccgtggtgtacgagtcacggatgcccagcctttgcttaaggtacgggtcgccctccaaaaggtccttgtgcccagcgacctgcaggaaaagctgctttgtttcttcgtagttggctctgaaacgcgcccctaatggccacaggtcctctgaaaccagaagcttgtcgtacagcgccgcgatgccaggatcacccttggcgaacaccatctcgaccaggtctatcgtcaccctgaa

SEQ ID NO: 16694 - DNA, 581 bp, Zea mays
  unsure (1)..(581): unsure at all n locations; Clone ID: LIB3279-232-Q6-N6-A3
catgtccaaattacacatcatgtagacacatgtacaccagtctcaggacaaaattacaagagcgtaaaggaaaaaaaatacccgcaaccatccacaaatctccacaaaccacaattggaaggagataggtcgggtcttgggactctcaaacaattttgatccctggtaaccctaaaaccccagcctacgctgctcaaacagcgagttcggcgtcgtttcggggatcgaaccatgtcggagacgaactccacgtccccaaagaggccacacagagcatatggtgtgccctactgtccccttcagcctatcaagtccttgaaaagattggggttgttcactgttggtgtcactcctacttgtcgtgcagccgcttccttttgcaaggcatcttggaggctcgggcccttcattgaatccactgcagctgctcctttgcgggagcccatcgaattaacatcacctanagtgggatcgggggacacactagtcactccggttggcacatcatctgagaagattgacagaaggcctggcgctttggaagtgctggtagccggngttccagaaagccccggggcatc

SEQ ID NO: 16695 - DNA, 598 bp, Zea mays
  Clone ID: LIB3279-232-Q6-N6-A4
ggtatcattgcaaaatgataatcctcacccagtagttccgagttgataccatacaaattgtgtgatggaacattaattgacaaaattgaaagagcacagtccacactgcacagcacgcaggtctatttagatgcagcgagatctcgcgacggatctggtctagttaacaggcaagatttatcaacctcaccagaggtagccggggatcttgatgcggaggaagagcatggccatggcgtaggcgatgacaacggcgactgcgccggcgcttccaaacgagacgcggaggctccggggcctcgtgcggtcgacggcgaggtcgaggaggatgatgccaatgccgccaaggaggaacatgaacccggaggagagtccctcgatgatgtactggccgttgacgcgccctggaaggaagacgacggggcggacggcgccagtgccggggtcctgggcgctgccgatgccagggggctcaacgatgacgtcgtacacgagtccggagacgaccgcaaagtaggtgagcaggatgagggagaagacggtcatgggagagggaagcgccagttcgacggcagcctcaagcgggtgcgccgcggca

SEQ ID NO: 16696 - DNA, 623 bp, Zea mays
  Clone ID: LIB3279-232-Q6-N6-A5
catcagaaatttgtaattgattggcggatcagtattcatcatccctgctagaacaatcatgaaaaatgatcagcaacctaattaactgaagctacgttcgctccatcatctctgtgccaagctagaacaatcatgaatcagtaaccaacgtgccttgcacagagggagtaatgcgaataagcaattctctattacacgttgaccgatgcgaagcaaccaatttgagttgatggatcgcagtcccagccccgctggctgccggtgccgggacgctctcagtcttcgttcagatcgacgatggtcgcccgcattttcatgcatcggaacgcctttcaaacaatgctgcactgtacaagatgatatggtattcttgatcatctcagcagcgcgtactcggcccgcggcttggtgccgcggccgtcgtcgtcgtggagctcgaggccgtagagcacgccggcgcacatctccaggctgccttccttggggaagtagagcctggccatctcccggaaggtgtcccacgtgagcacgctgtcggacgccgcctggtggctccggcccgcggcgcggcgcacccggagcgcggcggcgacgcgctcgagcccgccgagcagcgcgggggc

SEQ ID NO: 16697 - DNA, 604 bp, Zea mays
  Clone ID: LIB3279-232-Q6-N6-A6
aaataaataaataaatagatagatagattttaatcgattggtattagattgttctcttcccacctttacttacaccatcttccattatgttccacatttccctagcagggcaggagctgctcaagagaaccaggaaataataattacaatcataatgtgagcgtataaatattgacttgtacagggccatgctccatcttcggcagggctgcactacccaaaaaaaaactacatgatccaaccctcctcgtcgccactgctaaaggattccatcatatcactctcatcgccttccccttcgtcatcacccaaaatatccatcaagccccctcccccttcaaaatcaccaccaccatcaatgtactctgggtcatcttcaatgtcatccgaactggggatatcatcgtcaccaccatcttcatcaccatcatcgctgctgctactaatctcttcggaatctgtatccccttccagcaccggcgcaaggagaacatcatcatcagagtcgccatcgtcgtcatcgtcatcgtcggtttcacctgcatcctccgggtctgaatcgtcatcggttattcgcttcctgccaacttcgaacaagcgggca

SEQ ID NO: 16698 - DNA, 487 bp, Zea mays
  Clone ID: LIB3279-232-Q6-N6-A7
gaaccaaacgaaatccgatcaaaaatcccgcatataggacgaggcaaatttgccccctttacaactaaaacacagggcatgaatcgggttccagttttgcgcgaggtccaaggggtccaacattggggcttttattccaaacaacagctaaaaaaaaaggggcggaaaaactggagccctttatttaggctactactgggactgggggaaccagtaccaacatcagggcttggggctcacaaaagccctgggagcgatcaaatccaaaacccgggtggtggagccccactcgttggcaaaccaaaacacaagctttatgaaggaaaagctcaatccaataccagccttgggataaaaaaagcttgaccttgaatcaccaacaaaatcattggaaacaacatcctcgtctgggtagccaaaaaacctttgagggcaccctttgatgcccgcttgaggggtgctttcacaacatcaaaggaggggcttt

SEQ ID NO: 16699 - DNA, 612 bp, Zea mays
  unsure (1)..(612): unsure at all n locations; Clone ID: LIB3279-232-Q6-N6-B1
cgtcgccatgcaccgcgtaccgtaagncttggnatnncctctagnanncggccgcnnccttttnntttttttttatattttttttattttttatatttttattttttttttttttttatttttttaaaggaaacaatttttaaaaacctggactgttattaaaagaaatcaccccttgttgacttttaacatatcgaaccaattattattggctccacaactgaaaaacgcaccatcactcgatgagggcggggatggcaatgcacaagaccgggatctggtgggcgtactccgcgcgccgggcgagcagggacggcatcccggcctggggaaaaacggggtcgaagcgccgccccaacgcgatgccctccacggccatttccttccccgccgggtactcgcgcgcgttgatctcgtcgtacgcccccgcgagcgcgagctccatgtcaaagtaaagcctggggaactgccccagcgccgccctcgctttggggccgtccgcgcccgcgcccgcgcccggggagccggccagaagcgcctccgggtcggggaccgccccgccggcgttgttgaccccgaggttggccgccaccttggccaggccccaggcgt

SEQ ID NO: 16700 - DNA, 612 bp, Zea mays
  Clone ID: LIB3279-232-Q6-N6-B10
cggctgtaaagtttagaggcctcagaactactgctgcttgcactgctgccactacttgccctgtcactttggcagctacagtttatcaaagagcatgtgtcacaattctgcttatcctttcccagttttctcttaaggcgtttgacctccaatgcaacttcatttgacattctaacttcgccatgagacttctgttctggtgccaactttgcttgatgactattcaatctgtgatattctgcatagacgtcaccaacaagcatccatgcctttgcccagaacaaataatttggtggcaattggtgggaagaaacttcataactgaagcatcttttgttattgcaatagtctgcctcgtccagtacaagtttagtttttagggcaagatcttctcgactcaatgaactgttggacatggatgagatgaactcgtcgccatcaatatgtccaggcatagacccatataccaaacaagctaattcaacaactttaagggtgcgctgaagctgcccatcattcttgtatgcctctccaagtgccaaataagattctcctagcaaaaaacaagcttccacagcttatggtccatttttgattttggcaaccactccc

SEQ ID NO: 16701 - DNA, 610 bp, Zea mays
  Clone ID: LIB3279-232-Q6-N6-B2
atactaggtcgcaggcctggccataagtaacggaagcccatgcctcgtgcaatattgcagtattcgtacgtacataagagtattggtatatgcgaaccagcctatcaactctgttgcattgcgcttgcagcagtcttggactatggtagctagtagctggtagtagtagtacacggtagcacacccacccacccgtcgcaacagccatgcgacaacgaatagacgacgcgttatttccgggcgggggccgcgcgcgccggccgtctcggtctcccgctccgggcgcccgccagctcacgccggcgtgagcccgtgcttgagcgccgcctcccacacgacgtcgatccggtccacctcgagggcgcccacctcgtggtgctcccacccttccaggcagtgcaccacgccgccggcgtggcacgcgtgcaccaccccgcgctccatcgtgtactcgcaggagccgaggccctcgacgtccttggggagcctcatggcggcgagcttgccgtatgtgcagtcccggcggaagccgatgatgggcggcactacgaactggtggaagtgcgtgcccggcggcgcccaccgctgctcccgcggcgacagccacttg

SEQ ID NO: 16702 - DNA, 563 bp, Zea mays
  unsure (1)..(563): unsure at all n locations; Clone ID: LIB3279-232-Q6-N6-B3
gccgcggcaaaaaaaactatgtgaagtccctgctgttaccctataccaagatgtaaagggtacttcagtcacttacactccattcactatttagagtctgacaacggggaggtccagatcgtcagatccacgatccagggatgaaaaaaaggaaaagacgatctattcaaaggaggggaaattggtgtaggtgattatgaggtccccttctcgttctttgttgtccggggtngctcttttgccattgtggagaatgactgggcgccgctcgccatatcggcagctcgaaggttaatgccctccaactttttcatgttttcctgcagcttgttcccaatcatttttgtgacactggttgagtcatcatttgttgtgtttgcctatccatacttcatctttatctgatcgacttgactcactgatgtttcatcttcagtttttttgtttcccgagcttatcttttcttcagtcttgggcttcaactttcctttaagggtttggagtcccttgctggttctatctttgcttatacccgggaatgtggaccttttggcctttggggg

SEQ ID NO: 16703 - DNA, 605 bp, Zea mays
  Clone ID: LIB3279-232-Q6-N6-B4
aaccacagcagcacaaaacgtcaagcatggagcacattaactaaaactggatcacgtttgggtacatgtccgtaacatgttacatgttggatattattgctaaaatctactcagggcactccaagagtaaaatctgcaggtcgcagtaaacagtttcacaggacttgtgcagacataaaagcacttgcatcccgcccgtttagtagggctccacaggtgcacggaatttggcacctgcgtagacagcaatagcgccaagctcttcttcaatcctaagaagctggttgtatttggcaagacgctctgatctgcagggtgctccagtcttaatctgacccgtggacaaaccaactgccagatcagcaatgaaagtgtcctcagtctcaccactcctatgactagtcatcacaccccagcccgcacgctttgacatcttcacagcctcaatactctcagtcacagatccgatttggttaaccttgagcagaaggcattgcatgatttctccttgatagccttagcaaccctagtggggttggtgacgagaaggtcatcaccaacaatctgcacttgctctccaatttcttcagtcatcttagcatagt

SEQ ID NO: 16704 - DNA, 626 bp, Zea mays
  Clone ID: LIB3279-232-Q6-N6-B6
gataattaatactagaaagtagagagacatgaaagcatagaaaatacagggtccagaatgtaaccacagataatgataagtcaggtaggtacgacacccagcaaccccttgcacgctatagcaaaagccagctcaagccaggtgaatgtctcggtagcaatcctttggtgatacacttcttttccgatttaagttgagatacagtagggttccgtctccaaagccaaggaagttacttggggccaacatccttcaacgcgcagatctgctcctcccccatcgcagactggacagtcacaacaagatccttcccgctttcgaacccttccttaatctgggccacaagagtctcatcagttgggagtctaagatcatccttagtgttgccatctgaagtaagaaggctcacaaatccatcctcagaaatatcaatcagctgatactcagtacggttcacatgcggaatgtcacagttgtgtgatgaaggaacaatatcttcaagctttttcccattgaatatgtctatggcgacaaagtggcatttggcgtggccatgcttaccagtcttggaggtagaaacctccacaaccttgcagggacggttcttgatgacgatgaagccgttc

SEQ ID NO: 16705 - DNA, 503 bp, Zea mays
  Clone ID: LIB3279-232-Q6-N6-B7
cacagaatatgtcatcattattatcaggggaccatctgtatcatagctagcagatgggaggttgaaacatctttcgatcaagcaaccaactgcaacatcgcggaacacagaacacaagaggtaccactgttacaatcacacttagtgaagcgcaacacagatagacagctgccttatcatcctctaggtattggagacgggtgaccagtctcatttctttccacttttcttcagacccgagcccccaatcgcgcccttctgtgccttggccttaagctccttcagtgctttttcctcatctttcttcttctgcagatatgcaagatccgtctcgtcgtactccttcttgtcggccttgggcgccttcagcggcttggccttccctccttgcttcgacatggccggcgggggcggataagcacgccgggaccgaaaccctagactggctggcgagagccgcgagagtaggtggggaaaggcacgcggaaccgggtgcgcgaggc

SEQ ID NO: 16706 - DNA, 615 bp, Zea mays
  Clone ID: LIB3279-232-Q6-N6-B8
gtcgtaggaagaagcagcaaattaactaacctggaatggggacaacataactgcaccagaaactcagtagtacaagaaacggcaatcctgtcgtgggaaaatgcagtgctacaacgaagaagaatcacgagagagactctcgcaacaagggtgcacgctgaggagctggcgtgtgagattttagtgatacacgctgcactgatcaatggtcatgctggttggatggagtaatctgtgctccactgctgctgtcactggcgagaagccgaggaaacagacggcggcggcggcttgtcgccattgccgctgccgccgttgtgctcctcgccgccctgtatcctggtggggatgcggatcccggagaagccggtaccgggcgcgaacccgatggtcggcccgccatgctgctgctgcatcgggttgtcggcttcgacggtctccggccatcctcgctcggagggctggttactggactgaaggggtcccctctgggagaagaactggctctggccgccaagcgccgcctgctgcgacacgttgagcaggtagccgccagtgctcccgccgcctgggtcgggcgcgttccacggcgccacgcgctggctctgcgcgtgc

SEQ ID NO: 16707 - DNA, 324 bp, Zea mays
  Clone ID: LIB3279-232-Q6-N6-C1
gccagtcaaaccaatctagccatttataaggcaacagaggaatacatcgtacttccgagccacaacaaatgtccatacaaaccaaaaattaaaacacagccgatgatatgcaaagcacagcatctcacagttctgacctatgccttgatagcatacttcctcatggggaagtacttctcacgcttcttttccctctccgtcttcagagaaagctggtgcttggtcagacggcggcggatggcacgggtcttcttagggcggaggtcgagggggagcaggttcttcttcttgtacgcctcccgcaacgccgacttctgcttctgc

SEQ ID NO: 16708 - DNA, 606 bp, Zea mays
  Clone ID: LIB3279-232-Q6-N6-C10
aaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaatagctttcttgatttcctcgtaggaggcccccttctcgattctgacagtgaggtctacaactgacacatccacggtgggaacccggaaggacatgccagtgagcttgccattcaattcaggaagaaccttaccgacagccttggcagcaccggtgctgcttggaatgatgttaaaagctgc

SEQ ID NO: 16709 - DNA, 519 bp, Zea mays
  Clone ID: LIB3279-232-Q6-N6-C11
gagcccattagctagtactctatttatttttatttaacctgatgttatctctccatctcgggagcctggcctaaacgtcatcacatgaaacggggctgcgtcaagcggaaccagagctcgccgttgtacagttgacagaggagcaaatgtctgagggtctaactctaacggctgggagaacctgctgcttgctaacttcaaaaaatatacattttcaagattctacatgttcaaccaccggtttgctcaactgcagcgcggggttcctcccgtgtctgtaaaatttggggaaaaggagcgggaatttttaccatcttattgggtgggggggggcaaaaaaccagccaatgggcatgcaggggatacccacagtctccaggaacagggtgcaaagggctctcataacccccatcagatgcaaaagaactatctgtgccagtagattctggctcaacaaaattggggtgcccaccaataccatagagaggggcatctacaagtgggggcccaatgtatgca

SEQ ID NO: 16710 - DNA, 610 bp, Zea mays
  Clone ID: LIB3279-232-Q6-N6-C2
catcactcaagtcgaattatgttagcgaaacatctgttcgactccacagaagcaagcaacaatgacataagagttgtccctaattgcctcaaatcataaagctcctacaagcccacacgtgctgctgaacgtgtggatccttcttaactctctatgggaaagttgaaatgcgaggatatgacgaaaagccaggcagaactcagcgcacggtaactaaagccgcagaagatcttcacttcttcctcttctttgggggctggagcgagtcttcatcatcatcttcctcctcatcctcgtcctggtcatcatcttcttcatctacaccctcctcatcgtcatccccattgtcgtcgtcctcgtcatccccgttctcatcatcgtcatcgtcgtcgtcgtcgccgccaccctcctgatcttctggttcttcctcatcttcctcaccattttcctcaggatcacctctttgcttcttggtctcattgccctttgggttgtcatatccctccccttctgagacgtcctcttcaccctcctccccaagtcaccatcctcgtccccatcgtcaccaccatcatcatcttcatcgccagcttcgacaggttcgagctca

SEQ ID NO: 16711 - DNA, 586 bp, Zea mays
  unsure (1)..(586): unsure at all n locations; Clone ID: LIB3279-232-Q6-N6-C3
actcgaattaaatccaagagattataattaaacgaagtttgttccaacagtatctaaaacatttgaaggataaacaatttattatttatccctgtacaaacgataatatctgtttcatgaaaggaatagaacaaacagctccaagtacaaatcatcaacactcacgccactctttggcactggccaccaaatgcgaaacctgttccacgtactggagtgcagaaacggacccagatctcacaaagacgcaaactgcacgggcgacagccgacacccttgcgttgtgtaaaaacccagaccaactgcgcacatcaggaacatcctaatatggcactgttgttgaaaaaaaaaaaaactaaactgacctgacgatctatactgctgaagtactgcacatgtttcttcatgtngtaccatcaatcgactttaccaccttgcacaatgctccatggccaacagctcttcaatttccagaaagaacgaaaaatgctagcgagaccacgggacaaacttgcatcccaactaactgaaaatgcngcaacagatatactgctccagaaatcaaagccttnatgtggactatgcc

SEQ ID NO: 16712 - DNA, 607 bp, Zea mays
  Clone ID: LIB3279-232-Q6-N6-C4
aacaaactaacatgagtgatacataatgcacaacttagatctaaaacagttttgagttcagcacaggcgccctgggagaagattgaagaaatacaggctactacaattagttgctagttactaacaatagatctagaacgtctttgacatactacagcaaacagcacatcaagaacctacacagctggtcctacactgaaagcaacagccatcgggcattcggtccccatgtgggcgttttacatcaagtcaggcatgagagatggatatatccagccagcatcatcatgctcgggctctcttgccactaccgctgcagttcggacacttgtagtgcttgatgtgttcggccttggcaggagtgatcttgacacacttgccatggaaccaagtctcgcacgcatcacagcatatccagaactcatcctgtccgtagttgtcaccacaagaaccacacagcgtgttttcgtgatcttcctcttcctcctcttcctcgcctccgctgtcatcctcatccttcggaggtggcatcttcgaaccccttgagttgggttctggctggcgtggcggttttgggccagctttattgctcttgctgctgcttttg

SEQ ID NO: 16713 - DNA, 426 bp, Zea mays; identical to SEQ ID NO: 15879
  Clone ID: LIB3279-232-Q6-N6-C5

SEQ ID NO: 16714 - DNA, 488 bp, Zea mays
  Clone ID: LIB3279-232-Q6-N6-C6
ccaccctaccgcaaagttatttttaaaaaaaatcccaggaatggctatttcccaacaatttaatggtttccttccaggcacccttcctcccccttgggccctaacctttctcattagagacacctcacctgaccagccaaccatccctgaacaatctgggtttttcccttcaaccgttggcagggcaacccgtttaaggcgattggttcattaggggcaatgcctttttggccagccggcctttccttaaaaccatcccacctgccctcaaattccggttagggtccagccccatttccgtggggcgttccaaccagcccaaagtggccaaacccttggttcaggccagcaaggctgagaaatcttccacaaagtaccttgacttggtccagccttgcttggacaacctttaacacctctttaaccttttaaaggtcctatatcccacttttttggtcggggtttcccccaaccttaggactatgaag

SEQ ID NO: 16715 - DNA, 538 bp, Zea mays
  Clone ID: LIB3279-232-Q6-N6-C8
agcaacccaaaaccaaaccgggccaaattcaatcaaccacagaacgatttgaaacgagtacatcgaggagggggcttgttttcggtcttagacgtgaaatgggacactcagttcctttggtgactatgaaacttaatgactgccgaagcacaatggcacggggcagtgtatgcagcgctgaaatgggcagcatatgacatctcagtcacgttcactaattgccggcaggggctgatcgatctcctctggcgggagagctctgaaaacgcgggcattttttctcacaacaccaacttcgatctcaggggccttgaaatcttcctggagaactgattgcaacgcaaatattgcaatctgcacagtttcgtcataggggaatttcgggtcatccttcattttcttctccagaaaatttattggttcctgctccttgagcccggcactagttgccttatgtccaaagaagtgaccagcagggtcgcatttgagtagttgggcatttttctcttcatcgtagcccaagaccatagcaactact

SEQ ID NO: 16716 - DNA, 549 bp, Zea mays
  unsure (1)..(549): unsure at all n locations; Clone ID: LIB3279-232-Q6-N6-D1
tttntttttttttttttttttttttttttttttttttttttttttttttttttttttttttttttttttttttttattttttttttttttttttttttttttttttgggcaaaaaaaggaaaatctggccaaaaaaaacccctttcccgggggttggaaaaaggaaaaaaacaaaaacccaccccacgggccctttatttggggggaaaaaggggcaaaaaaaccaaaaaggccaaaaaagtttcaaaaaaaaaaaaacccacaggacgggaaaaattccccacggggggccacttgggaccgggctaaaaaaaaatggaaacccccaaaccaggggaaaaaaaaaaaaaccccggaaaaaacccccgggagattaaaaaaaaaaaaaaaaagttggccctgctgggaaataaaacccccccaatcccaccaaaaccggacggggggggggaaagccaacccaacaaacccctaattggtacccaaccaacggaagggcgcatgttagggccacccaaccaattccacggataaaatattccccccccc

SEQ ID NO: 16717 - DNA, 570 bp, Zea mays
  Clone ID: LIB3279-232-Q6-N6-D10
aatctcaaataccttgaattgcagaaactacctcaaagtacactccattctgtctcaataacgttatagaaacactggaagtaaacatgtcgaaacacttaaaacaccagtagaaacacttaaaacaccatatctggctcttatgttcataactcttgatcagataaagcaaatccttacattacataagcaagccagaacatcctcgggactactggttcaaccaacttaatgatctggcttcgttgaaatgtcttatttgaaatcattgcctcacttgggggcttgggatttcttttccagatctgtagggcttaaatcaaggagctccacaaaatgcagggcctacaccaacgtcctataatgccaaatcttagtaatatgaaccggaaccgctacctccatagtagccaccactgctgctacccaaattgcggcctgagtaaagcgaagaatatgaactcccaccaacatcagatccacgagacccatagctaccactgtaactcggtgggtacataccaccagcatcagcactgctagcagaacctccataactcatgccattac

SEQ ID NO: 16718 - DNA, 435 bp, Zea mays
  Clone ID: LIB3279-232-Q6-N6-D11
tttttctttttttgtttttttttcttttttccggcacgcaaagctatggtagtatcatttcagcaaaatatacgtccctggcgcacaaaaacagaagggcagacgcaccaaagaagattacagtcatattctctagcgggctcacaggaccctcacagcgggagcggaatggcacgagaattacaaaaggtagagctcagtgggagtgatttgggttggctgctcctattgacaaatccttgggaaaaactggtgacggcaagcatagcttaaagatcctcagggccattgacatccttgttttcaaatacagctccatctggaacctccaacttcactccagacttggcggtgattgtcaccttgcccttgagcgtaattccagaaccaaaccagacatcaccagaaaccttcaagctgtcacccacgcgtccg

SEQ ID NO: 16719 - DNA, 624 bp, Zea mays
  unsure (1)..(624): unsure at all n locations; Clone ID: LIB3279-232-Q6-N6-D12
cgcgtncgtnnatctttttttcctctgngncggccgcccttttttgtgtttgtttttttttttttttttttttttttttttttttttctttggcttcttttccccctcttgttccctcccctccgtccccgcgctgtccccccccccnccggggggtcgtgccccctttttctttttctttnnttctcttatgttcgctggggggctcctttttttttnntcttcctcctcctccccccccgggtcttttcttcttccttctcccggttctccccccctccccttgtttttccccccccccttctttgcccccgggcggctccgccctgcccctccccgtgccctccgcgcgttcccccccctttttcttcccgtccccccttctcctcgccccccctccccccccccccccgttccccgcgctgttccccccccccccctttcctgcctccccccccggtgtgctccccctcctgcttcccttgcccctcccccccccccccccttgtcctcttcccttcctctcccttcccntccccttccccccttcctctctcctccccccttcttccctcctttttccccttttcttcctctccttctcccccccccccctccccctcc

SEQ ID NO: 16720 - DNA, 567 bp, Zea mays
  Clone ID: LIB3279-232-Q6-N6-D2
aaataataatcccaaacctccggaaagaagacagatttcttccatacacatctagttcgaaacatcaaaactgcatgcatattcatcgacgatccaactttctaatataaaataaggacagcacaagaagtcacttagagcacagggtactatcaatgagcttgatcgggaacctaattcatccttttgatgagctcattgatgtagttctcgcggttaccggcatcgccgccctccacataggggttcctcttcttcttcaggcctcccagcggcgccttcaacttgaatggccagaggaagttgttggcctccttgaagtgtgggccaacagtcatgatctcgtgaacaagatcctcaatgcagatgatgttgtgcttgcccaagccctcctcgatgacttggttgttggacagagggatcctctgcttgttcagctttccatagcccctcttgtagatcaactccctgacactcttcaagtttgggtacccatatgcaacatatggctcaaccctgcgtagcatgttaatagtcgccttgttgactttgaggaacacaccattg

SEQ ID NO: 16721 - DNA, 610 bp, Zea mays
  unsure (1)..(610): unsure at all n locations; Clone ID: LIB3279-232-Q6-N6-D3
gttttttttttttttttttttttttttttttttttttttttttttttttttttttcggccccctgggcggccccgggggccgccccgggaaccccggcccggnccccgcnggcgcccccgctncccctctnnngagccgnntcggggccggggggggggggggccctcgctgttccccgggggaanttggtgcccgctccccntccccccccccctcccccccggnncccnnnnngcgccnccccggggcgcccccngngcgcccccacccccnnnnntngggttgcccccccggcccccccccccccccggnnccccgccccccccccccccccncngcnccgcccccccccccgtgcgcggccgcccccccctcccccccccctgttggtttttttttttttttggggccccccccccccttttttttttttcccccccgccccccccccccccccccccgccggccccccccgncccccccccccggccncnccccccccnnnncccncaaacccccccccccccccccccccccccccccccccccnccccccccccccgccccccccccccccccccccccgcccccncnnccccccccctcgac

SEQ ID NO: 16722 - DNA, 539 bp, Zea mays
  Clone ID: LIB3279-232-Q6-N6-D4
gcgggaagcaacgcccacaactgactttatttcagggacaaaaaaaaagtgcctatcacatcagttctctttaatcttaaccattctaattctagcatccaaaatctgaaaatttaacgagtttttaaaacatcagagttcctcagatttacaggcaggctaatcggcacgcagatcagttacagaatcgtcagaactacaactcatcgtttactgaggagctgtcgcccatgagctcgtcaagggagaattcatcctcttcgatgacctctccgtctttgccgtcccacgggtcggaagtgactactgtcggcgcaacgttcaaaggaagatttccctttccaccgcgccctgcttccttcacaaactcgatgatttcgtcgcgctggaaggcattacggagtggagcgtatgcacctttcttcacgttgagagcaaccatggcgggatagccgtagccgcccactccaacctggttctcgagattagcttgcttgccagcagctgtccagacaaaactgtatggactctttttatac

SEQ ID NO: 16723 - DNA, 625 bp, Zea mays
  Clone ID: LIB3279-232-Q6-N6-D5
gaaataggaggtagaatagataatgtaatagaagagctgctggagaccatctagctaaacatatcacatctttctacatggtagcaacatttcaatttcaaatcgttggtctaacgccatgacatctatcatacactcacatgatcagtttctgttgcagtggagccttgattctgctttactgcacgagatatacccgacaacttgcctcataaaatctcatcagtatcatatatattgaaagctcaacgaacccttctgctatgttaggatttctcatctgacagacctcagcacaaatccaacactgttagcaactaaagctacaacagactgcaccacaattctcaacactgccatgtccctgcaaagaacgcaactactgctggacttcaaaacttcctaccatcccaaaaggatactttggcggtcatccacaaaagcataacactatctccaacagcttacccatacacatagctatattcaaactccactctgcaaacagtgcagtcttcagtgcataacagtgcttatggataaactttggatgaactgatggagtcaccctcgctgtccaaggacatgtacttggctactgtcttcagagaaaaaactaaacaat

SEQ ID NO: 16724 - DNA, 594 bp, Zea mays
  Clone ID: LIB3279-232-Q6-N6-D6
aatattccccggcttacgccttttcgctgccttaccgtcatattaactatggtagcaataccataaaatacagatataaagccggactgaaatacagacaatggtggtacatctcacaacatcagtacaacaaaaataaagttagagcctttccgggtccaaacaatacttccttgcataagcaacatagttctgcggctactcaaaatgtgctccgtatctcagagtcaaagtgacgactttggaagattatatataactagcaacctggagcatttgccactctgcagacagaaagaggactccagtcgaatattcagcctaattagccacttggagcatatgtcactctgcagacagactgggacgcatattcacaaacatgaacccacatatgatcgctagcttcactgcctctggacatgtcatgggccaaaagattcgctcataacgaatgcttcaacgagacttcgggctgcatgcatctgctctggtgtgccagatatcaaaacagcagtgtccatcgcatcggctgtaggctcagcgacagttatcttagcttcagaaaactcacggatcctgtccaaacaacct

SEQ ID NO: 16725 - DNA, 566 bp, Zea mays
  Clone ID: LIB3279-232-Q6-N6-D7
actaaaacgcaagtcacataatattaaattagccggaaggcgaaaaggaatcccataataataataaaatgtgccggaaggaaggagagacagaattcttagatcttgtcgatgtcctcgtcctcgaactggatgtagttgtagtcgccgttctcctcgccctcctcgggcccatcgacgtcgacgccctcgttgagcctgagcgtctcgggaagctccccgtaggccttgagcaggcgcgcctcgtcgttcatgtacttgaggatgacgtcggccttgtcgtcctggtagtcgcggaggccgacgaggacgatgtccccggccgcgatccacaccttcttgtgcatcttgccccggatatggcagaggcggcgcgtgccgtccacgcaggtggcctcgcaccgcccgttgccgagcatccgggtcacctgcgcatactcctgcccgtcttccttgaagacgagctcgcgcttgtcgtcgtcagcctcgttctttccacgcttccggttcttgcctcccttacccttgttcttcggcatcttcgcggaggacgagagcggtgtggc

SEQ ID NO: 16726 - DNA, 606 bp, Zea mays
  Clone ID: LIB3279-232-Q6-N6-D8
gacattgtggagatcatagaacccagatgtctctgttacaaaatatattatatacacatcccgttagtcccgggacgacatgcaaaatgcactagccaactcgcacgaacacgcaagtacattaatgacaggaaacttgggcagaaattatctgcttctgcactagacagccataaatccttgggtaacccatggaaataatcgatcggcggcggccacagccactcctagatagatgtaattatggttgtggtggttcatgctgtggtgtggccggggagtccggtgcgatggtgaaatgcactccccttccttggcctgactgcaggatgaatgccacctccgctgcagctagagcagctgcctcctgtctctgtctgcggcgctgcaagatactgattgcccaagccatgatgtagaacggaagcaggaaaccagcagcacgcaacagaaaaagtgaaaacatcgctgaagtgtcgtcgtcatcttcatcagttagagtcagtgcgtgtctcaacaataagagagccattaaaacaagagcagcagagcggcagaaggcagcagtgctcgcatttgtggcagaataatcatcatattcagctt

SEQ ID NO: 16727 - DNA, 79 bp, Zea mays
  Clone ID: LIB3279-232-Q6-N6-D9
tctctctctctctctctctctctctctctctctctctctctctctctctctctctctctctctctctctctctctctct

SEQ ID NO: 16728 - DNA, 418 bp, Zea mays
  Clone ID: LIB3279-232-Q6-N6-E1
ggaaaaaacgctgggctttgggggcctacaaaacacttattattaaaaaaacgggaaacattccagggcagaagggccaaccgggcccaggataaacccctacaaaaaaaaagggggggataattttaaacccccgggcgggcagaacaaaagaaagggggcccgaaccgggccaattttgggggaaacccggggggggattaaacccagcagcaaatgggaggggccccggttttctaaaagccccccgggggggagtaaaggggaatggtggggaaagggacccaatttttttgggttgggggccaaccagccccaggggacagcctaaaatttatgggggggggggggggggggggaatcataaataggggagcatggggggggcccccatgggcatgggggcacccgggtaggg

SEQ ID NO: 16729 - DNA, 619 bp, Zea mays
  Clone ID: LIB3279-232-Q6-N6-E10
attatccaaatcagaccctcaatagcaatatagcatcgtcgaaactgtccacagtcttctcgtgcaaagttacacaaagtcctgcatctatgctgtaaacatgaactgctgctgataagctacccttaacaaccatatagcatcgctgctcaagcaaagtttttgcaactagggcaaaagcttgatttgccacatagcgcgacagatctacctcctcacagggggtgcaccacctcgtccaacaggaccaccgccacgaccagcagcagccctagcccgcatggcgaccgcgcggcctcggccgacaccaacagctgagcctttacccctaatcctggcctcaaggcgcttgaacattggggcgttcttgagcatgtcgggtataatcatgaacctgaccctgctccccctgatgaagacgtgctccagctgcgacaccttgccgtcctttgccgtgaaggtgatgttttcgagctggcagttccagttgtcctcgcactcgaccatggagccgcggtagacctcgccggtcttgagctcgaccgtgacgacgtggcccgccgcctcatgcagcagcttcaccgggataccgaggctgcggctcatcgtctaactgggc

SEQ ID NO: 16730 - DNA, 578 bp, Zea mays
  Clone ID: LIB3279-232-Q6-N6-E11
ctagattcaagaacacaggatgaaaagacatgtcatcaggaaaaaaaacatcaccaacagtcaacagatggggcataggtatcgtgtcgtgaccataattaaacaacatctggaatccaaaacacaaactatataggacattttccaaaccctcattcagaggatgcacaacattgaaaagctaatatgcagattattgaactgctaacataacccttgagtcgcaacaacaccataaagcttgagtctcccggaatccgttcatgccatcagtattcagtgggcgcgagatgaaggtgaagaagagaactgacagctcacgaacaggcacgtatcacatttcacgtgtagaggttgcagacactaaaagtaccactaagtcgtaagtccctcttatcagcagcagggcctcctagtacagcatcaaaagccaggttcgggtgaactttgacatgtaccgagtatgtcataccggtagtttctttttttctgaatggtaaaatctgtgaaaggtgaagcaatgaaatccctctcgaacaatggcgtgtgcgcccccaaagcggaagattcaccatgca

SEQ ID NO: 16731 - DNA, 621 bp, Zea mays
  Clone ID: LIB3279-232-Q6-N6-E2
gcgaagagggccaagcatcataaaatggaaaagatattcttatcaactacaacacgagcaattatttttcaagtagaaccagcgaactctataaagccctcaacacataattaggaaaaggaacagcaagcagatcgagtgggtcacaacacgaataaaatcatttctgctaacaccaacttaggctttgcggttcctggtggtagaacctttctgctccacagggtccctgcttccaaccaagtcccggtaacgctgctcccagtcatccaccttcccatttgcgatatctgcatggatcgccctccggattccttttactaccaagaagtactccactgcaagtataattggtatgaacatcttccagcgattgttagggtttggaccatcaattaacttctgatcaacatgaatgggcttgctcccgtttgagataacaacagtaatttctttcatcagttttggaacccacggagttccatccggaagtatcttctccccatgctcgttagtcttgcaccttccactgttctctaccaatgctattggcaaagggaaatccccatattctcgtttcttgattcctgctcccgagtggatgtatcgcaaagtgcctct

SEQ ID NO: 16732 - DNA, 596 bp, Zea mays
  unsure (1)..(596): unsure at all n locations; Clone ID: LIB3279-232-Q6-N6-E3
gtcctgctcaattacaacattaattaacacaaacgaacaaggggatcaggaccgtccgtttttatctgttaccgaggctagacacaaacaactcttcaaatctaaaggccaaattacaggtaatccaaaattggactatggagcatcgatcgaacttttttattacttgacacaaaggctagttagcttgacaccatcatctggtcgcacgcctgcagtgcctggtttgcgtagtaccttacgtcgacgtcagggtcctcgctgagctcaacgaggcacggtttcacggtcttctccaccacagattggtcgaggatcggtacaagtgactgtagtactttcgcaacattgaacttgatgttgggaaccctgtccttcgaagaattaatgacgactggaagcagcttttgacaggtgatctctgcacccatgacaggagctagcaaggagattgcctgcagaatcgtcatgcggnataaatagtgtgggttgttgatcttctccagcacctgagggattatatgctgcattgcccactctggaccaaactcttctgcaaggcgcttcaagttgttagcggccgcatctctgattga

SEQ ID NO: 16733 - DNA, 256 bp, Zea mays
  Clone ID: LIB3279-232-Q6-N6-E4
caaacaggcaccgatagctcattgacaaccatcaacgcacaggatgaaaccaaaaaaacaaataagaacaaagcagacctaggacatggcgagaacatagcctaaacatctacagtagtgacaatcaaccgtaaacgcctaagcgcgctccccgcggatgcggggggcgagctgaatgtccttgggcatgatggggacccccttggcgtggatggcccaaaggttggtgtcctcaaagaggccgacgaggtaggcc

SEQ ID NO: 16734 - DNA, 462 bp, Zea mays
  Clone ID: LIB3279-232-Q6-N6-E5
gggggaaatttgggcagcgcccctgcaatgttcttcaaagcacatgaatgccaaacggggtatccaccagttccctgcgaaatgtcagctgggggacgggttcccaacacaacacaacacaacaatgggcatttggtaaattggcaggcgagactagaaaaccaagactctgcatacagatgccggggagcccccacccccaggcacgaatgggtctttctcctctcctcggttttccactcctcctcacactcctccttagtagtatgtgcaggagccatagcttgggtcggactgcaccacgagcgcggagttgttgaaataacaattccaggggtgcctgcccctgtaggcgtagtaaaggttcatggggacgggggcgcgggacacggggctgtcccggtagtaacacggcccgcccttttggatcacggggcaactcacctgggagcacccctagtc

SEQ ID NO: 16735 - DNA, 638 bp, Zea mays
  Clone ID: LIB3279-232-Q6-N6-E6
aacatcatcctcgccatctagagctcgtcgtgctgcttctcatcatcagaatccttgctatcctcggcatcagagtcggccttgtcctcgtctgccttctcatcgtcttcctcatcctctaggtcatcatcctcatcatccccacccttggcggcatcctcttcttccttctttttctcggcctcatcaaaagcagccttttctgcctccttgtgcttgccccaagtctcctctgcaaaagtcttggccaacgcagggtcatcagtgatgatgatgttgtcaaacagagtgcccgatttaacctgccacagctcaatgccaatgtacttcaagctgtcgaaggcgtaaatgtatggatcatccttaaaatctgggttgtcaatcataggtgccttccatttaccctggtagttcgggttcttgattttcttttgtttccatggtcccttgtattctgggttgggaatggtaggggcagtccattcaccatcttcctcatcgtcccagtcctcaggcttcttagcatcagggtcaggaatttccttgggaatatcatcatagccctctggcttcttgtcctcagggtcaggaatgtactccttgtcatcccagtcctcatgcttcttagcctctgggtc

SEQ ID NO: 16736 - DNA, 555 bp, Zea mays
  Clone ID: LIB3279-232-Q6-N6-E7
agaaaaaaaaaatcagtaaactgaaggcagtcttacagagattaacatcagcatggacattagtacttatacactgactgatgaaacccaaggaaaaaggagaatctacagcagtccttcccatcatctatgatcctaaaacctttatccttctagtaactgctttgcttctcgacaaaatatttaaaacttctttatcctgctgcttgcaagagggggaaaaaacaatacaaatatacaagtctttcctcgaggacaagtaaaatctcatcttttctcattcttatttatttccagaggctctcctttatttacaaaggatttgggagcctttcttttttaacttctgcgggtgtacttgctcaatattaacgactactggtaatggtaaaaagctaggcctcgctatcttctgctgtacaggtgacctaaccattgccatctcagcaggagggtagtgcgccaatgcgccgttctcctgcggcaataagcttctcaacacgtgtcacaatatgcttcccataggtgtaccttttcagtgcattcaagtggacc

SEQ ID NO: 16737 - DNA, 492 bp, Zea mays
  Clone ID: LIB3279-232-Q6-N6-E8
atcaaacataatctccgtggttttttcacatagtccaaaacctcttggacttgatatgatctttcccccgatcaagaggatatattaaaatatgtttggcacgtccaacttcactcacaaatgtcagataaacatggactaacaccaacaaggcactgcaccgctttttgaaccataaaaacacacttcggatgaaagggctagcgcacaaaacttaagcccataagagtgggggtgccaggtcaacgtaatgcgctcatcgaatcaggcgtcttaccagacctggcattagaccaagctttggctatcgagcgcttcatatgctagtcaccctacttggacatgttcttcattaaccacataatgcctgacatcggatctttttgcttgaccatgtgtggcttgaacttgtcttccttgaagagcaagtataaccagttgtctttaaaacccttgaaaagagtaacagcatccctggatggggtcaccaca

SEQ ID NO: 16738 - DNA, 467 bp, Zea mays
  Clone ID: LIB3279-232-Q6-N6-E9
ggccttcgaaccccggttggtttttgggtcgcccaaaaaaaagctaaaatttaaacaaacccggagggccttcctggtttttttgggaaaaaaaaggaactaaaaaaaaacaaaaaaaggggcggaaaaaaggtcaaaaggggaaaaaaaagggaaaaaagggaaaaaaaaaaagctaaaaaaaacaaaccaaaaagggaaaaaggaaaaaaaaaattctcgggggggaagggatcaaaaaatggaaaaaaaaaaaaaaactgccgaaaaagaaaaccctaataaaaaaaaaggggggcctgcagttaaagggaaaaaaaaaaaggaaaaaaacaaccgatcggaaaaaaaaagggcaaaaaagggggggcaaactggaaaaaaaaaaagttttcccttaaattaaaaaaaaaaaaggggaaaggcgtaaataaaaaaaaaatgggctccaaaaaaaaagttcgtgg

SEQ ID NO: 16739 - DNA, 591 bp, Zea mays
  Clone ID: LIB3279-232-Q6-N6-F1
gcaaatccactactctctctcttacgttacgacgtgatgaggactcctcttgtcgtcgctttcttcggcgctgcagactttttaacttgctcgatcctacacctcagtgcaagtagttttcgtaggtcatggcagcgctaccagagtcccgcggtgcgttgcacctgaagcactccatcctgctggcgaagttgtgctcgttgcatccggatctggtgcagatccagtctccggacttccaaccggggcggttggtagtacgggcagcgccagcaccagcaccagcagcaccgctgccgaagccgtagccccgtgagcgtgacatgtcgccgtcaaagccgccagcgccactgttcacagcggcctcctccttgtaggcggagcacttgaagcagctggagcggctggcgaagttgtgcgcgccgcaggagcagtaccagtcaccagggcggacgtcagagccagcagcgccaaagccgccgccgaaggaggagccaccgcggccaccgaagctggcgtagtcgccttctcctcctcctccgccgccgccactgccacgatcagccccacgcgtccgcggacgcctgggcg

SEQ ID NO: 16740 - DNA, 447 bp, Zea mays
  Clone ID: LIB3279-232-Q6-N6-F10
gcaacatcatgccccatattattatcattgcaaaaaaaacaatccaatggtaaaaagatagattagtttgcctatttttatcagctattcagctggtcccactttcataaataaataataaagaggcctttccctaatggggaaatgctctgacatttccacgaccccagggacctacgggggggttcactaatttgaaccaagaaagggccaaaacaagacccgcaaaatctaattcccatgaaaaaaaggggggggttcacatttaaacacttcatcttggaatagcttaatatacaaaaaaagaccccctgcccctctgcaattaggggggcatatatcaccccatgtataatcatcgccacccttattactggccacaacctgccggatagggttggctttctccaaaattgctgcaaccttggaaccggctgtaaattggga

SEQ ID NO: 16741 - DNA, 632 bp, Zea mays
  Clone ID: LIB3279-232-Q6-N6-F11
cccacaaaacatgtttattacagtaatcacatttgatatacacacacttcggagacaaagcggaagacttacaaaacattcattacatttccaaaactcaagttttatatgctagaaagagttataatatttacaagtcctgatagtctttaaagtgcataacttaattacaatacttgaaaaggcgaagcctttccataaggaatacacataggcaaactaagcttgaagacctccacatgaagtaactaatgaagccaaagacatcagaacctttcctgcaacaacataaggaataaaaccctgagcaggcaattacccagcaagacttacccgactaaggaaaagactctcaagggcatgctagcttttgggaatcaagggaaaagctcatcaattatcaaagactcctctttgcagaaaagcaagcttactaagtagatccttaagccaagttttacttcacaggttaggttgttacttgaatctactaacctgaatctagattttcctaatctagatcatacacttggcctacactagattgtttttaattaaatctttgttatacttgttaactacgatgcagagtagtgatccagtcttcataaccgagaagtaacggtgatctg

SEQ ID NO: 16742 - DNA, 581 bp, Zea mays
  unsure (1)..(581): unsure at all n locations; Clone ID: LIB3279-232-Q6-N6-F3
catcttccgtggggccccctttttttaacaccacaccgggaagagccactggaaccatcccccggcgcaggaggggaacaaaaacggcgccccagagcgggggggggcgacaaacgcggacccctcaaccgggaaccccccccagcgcaaaaaaaaaccccnncgcccgcccaatggggccccccccccccaaggggggggggcaaaaaaccccccccgggggaaaaagaggggggaaccaagcccccgcccggccggcacaaccccccccccccaaanncgccccccgggaaccccccaaaaaaaaaaacccccggcgggcactcccccccctgctgctggggggggtgttacacccccccctgggggggggccagccctcccttccaaggccccgggaatccccccccgnccccccgggggggggccaaacacgaccatccgcacaggaagccccccccnggaggagacccccgaaaacaaacccccaaaaaggntctcccccccgggcccccccccggcntctgctccggcaaaacaccgggcccgccggccggggggggaaaaaaacagcccaaaaa

SEQ ID NO: 16743 - DNA, 540 bp, Zea mays
  Clone ID: LIB3279-232-Q6-N6-F4
aaaccaattatttttattcttgcaaatcacaacagtaccacaccgccaagagtttaattttctggtcctcaagcacgagcaatacaagcacaatctaagagttcaaaagcccaggcatattaagttcttacaaactagccattgcagtcacactgcggatccatacaagcttatgaagactgtcgaagctctgggcgcacgaaatctgcatcagcggtcactgagatgtcaacggtgggcctcagctgagcacagacttcgatggcaccgtgcacagggtcagacatgaagttgctgatgaggtcttggttgatcggtgctttcttgtcaacagtcacaaacgcctgttgggtcaagatgtaatcgaagcgtggtgcccatttcctagatcccaaacgagcagttgtggagcagttatcgaccatgaaggccacaccgcgagcatgcatgaacgggttcaacgagtccacggactcgatcaggctctcgttaattatctctgagtaagagtggcccttcttcctaaggacctcaatctga

SEQ ID NO: 16744 - DNA, 621 bp, Zea mays
  Clone ID: LIB3279-232-Q6-N6-F5
gcatgcagtttgaaatagtacagaaaacagggcacgatcttcgattacaagtgctccacagagagaagtcaaagatgagtaaatgagaccctgagcttcttgtccattgcagtttaaaatagaggtggtgttgtgtgcggtcgatcctaaaacagtgctcgacccaatcttattgggcttcataaaaaaacagagaacgaacgcgtgtcaaaatgctccaagacaacaggcaacaacgccaagcatgggttgagaaaaggttcagcgggcaaccgccttctgagcattgtgtgggaggatgttgtcgggaaggatgagctggggcgggatctcgcggaccaccccaagcatcgagtcgtactcctcgtctttgtgcgcgtacttcttcctcagcatcttctcgagctcaatctcgtcgaagctcttggcgttctcggctgcatggacctgggctaggttgatatagttggttgctgattgagcgatgaacgcaatctcctcttctgtaagcttccttaggaacttagcaggattaccgacccagacctctccagaaggaatccttgtattctgcttaacaagagatcctgcaccaaccatgctgtgcttttcaaccaccac

SEQ ID NO: 16745 - DNA, 595 bp, Zea mays
  Clone ID: LIB3279-232-Q6-N6-F6
gagccagcaagctagcattttatttagtaaaatcgttcacccgccggtacccaatcttttcagttttacacagttgccgtcttgaggctgttgcccttctcctgtaggctcacgagtaggctggcaaagctcttcttgaaggagtccacaccttccagctcaagctggtttccgacctcgccccagtcaatgccaagcttctccaaggggctgtatacaccttccgcctcggacacattcgcatcaactgtcctcgagacagtgccggggtctatgaatgcgtgcaaagcttggtcgggcatcgtgttgaccgtgtcaggtccaatgagactgtcgatgtaaagagtgtcgggataagctgggttcttgacaccggtggatgcccacaacaacctctgtttcttggcacctttcttggccaacgcctcccaccttgggccagagaatttcttctggtagagccgatttgctagtttggcctgtgcgacggcagccttccctctcaaggcaagtgcctcaggtgttccaatcttttcaagcattttgtcgataagggtgtcgactcggctgacaaagaagatgcgacactggtaac

SEQ ID NO: 16746 - DNA, 628 bp, Zea mays
  Clone ID: LIB3279-232-Q6-N6-F8
aaactgaaacctcattgtttattctttaacaaagcacaaaagaactaaaacttgcgaattcgttacaggacggcagcagataagttaaacacaaaaagacagcgtgtccaaaaccagcatggatccagcgtccaggggcaccgttcacatttattctcagcatagacaagcagcaaagatggtctgcgaccaaaggccattggggacgacccacgatagggaggcagaaatctatctctctactagcctactgggtcttgaacatgtggcggatcaggtcgacgacgcggttgctgtagccccactcgttgtcgtaccacgagacgagcttgatgaagtggtcgttcagggcaatcccggccttggcgtcgaagatgctcgacctgctgtcaccggtgaagtcggtggaaaccagatcctcctccacgtagcccatgatacccttgagtgggccctcagaagcggccttaatagctttcttgatttcctcgtaggaggcccccttctcgattctgacagtgaggtctacaactgacacatccacggtgggaacccggaaggacatgccagtgagcttgccattcaattcaggaagaaccttaccgacagccttggcagcaccggtgct

SEQ ID NO: 16747 - DNA, 484 bp, Zea mays
  Clone ID: LIB3279-232-Q6-N6-F9
ccagcccgaaaaaggggcagcccagcggcaaataaataagctatagcaggggaaaaacgggtaaaaggggtaatatcaaaacgacaaatccccacaccctggaaaccccaggggggcccaaaacccaaaggcggtttcttgggcaacaaaaaagcgggggatccccgggggggcgaaagcccccccacaaaaatccaccaagcaaaagggggcccccccccctgggccccctacttaaaaggcaggacctggaggacggaaaaaaccccgagggggggcagggccacaacggatggaccggggtggcaaacccccatcgttttcgcattttaaagggaaaaaccaaaagcttcggaaggggcttcgtggaaaaaggcctgggcggggggggcccccaacatggggaggacccccccaaaaaggggggggggcctggccggacccttgtaactggaggcccaggaaaacaagtttgttttaagct

SEQ ID NO: 16748 - DNA, 593 bp, Zea mays
  Clone ID: LIB3279-232-Q6-N6-G1
agtaatcaaattccaaagaatggtaatgcatcaactgttaattcacacaactcgtatcacctaatgcagcatataagtgataaaagtttttaaaacagcaaggaggtggcaaatgcactggggcttgcccgagataacactaggttagtgtggttagatgatgaccacttggtgagcatcttccatcctggcacttgatcagatcatccattcctctggtttatttgtcagcatcactttgagattaatccaacacttttcctccacatcgtgcgatcaattaacgtaccataacgaaaattttgattcggcacccatagacacagcgatgatccctggttggggtatatcatcgaacacctaagaagcgttgaacttaaccttcttctccacttaattctccagggatttttactccatatcgcacacataaacacacataaaacatcacatcagcatggtattaataagaacctatatgcacaagaaccactaaaacaacaaagggatatagagatcatcaccatagactccaaggagcagctgggcaccatggatgaaggtgttgttgttgttgtggggaagagttcggc

SEQ ID NO: 16749 - DNA, 607 bp, Zea mays
  Clone ID: LIB3279-232-Q6-N6-G10
gggactaaacctcttagggcagcagacgaagtgctttcatggtaataagttaataaccgaccattgaccacataagtcttacgcgagacattcgcaagcaaagtgactcccaaaatacttacaaccattaggacaacataaagtagacatagtagtagacaccaccaaacttaggcatcaatagatccagcacctccttactcgaaggcccactggttctccctgcggatctcctcttcctcctcaggggtgaagtcattcttgatattgaaggtcttgcgaatctcttctggtgtcttgcccttgatcatgtcagcaacagtctgacaggtcaggtcgagcagacccttgatgttcagatagtttgcagccaagatgaggtcgaaaagcgtggcctggtcgaccttgacgaagtccgcatcccagttcttgaggtcctcaccggaggcggcggtgctgttggcggaggcggcacccacgtcgtcggaaccggccttcgaggcggcggcggcggcggcggcggcatgtacgtgcttgttgcagtactcgattaccttggataggatcttggagttaacgttaggaagagggatgccgttgtcggcgc

SEQ ID NO: 16750 - DNA, 619 bp, Zea mays
  Clone ID: LIB3279-232-Q6-N6-G11
gcaccccatgaaaacgcagcatccaaaatactgcactgtattaacatcctccaataatctgtattcaaacaatgatttaaaatacaggtaatgcactaagccattctattatcgacctactatttatcacctaaaatgtcttcaagttgccgttgcctccttgagctttccatcatctccagttgcacttccgttaccattgtgaattagtttctcctctgaaggtagatgtttcatgatcttcctggtcggccccgaagccttccacaagtaccacacacgcgatttgggaggcggaacagatcctgccaagggagctaccaaccctggtttcccctcatctatgatattgtcaactatcccataatccttggcttccgaaggactcatgaaataatcaaacttcgtgtcttcatcaatctgctcctcagattttccagtaattctcgacattattttattgatcttaatcttttcgtacatcatctctcttatctgtagtcccatctctgtgactttcccgccagcgccacctgatggctgatggatcataatcctcgcatttggcatgcagtacctcttaccctttgtcccagcagcaagtaaaaatgcacccatt

SEQ ID NO: 16751 - DNA, 481 bp, Zea mays
  Clone ID: LIB3279-232-Q6-N6-G2
gggagcaaacagcaaacagcttaacggaacaacaaaatacgaaacttcctttccgagattggctgatccatcaagggttcaaagggctactcaaaatccggtttccagaagggctactcagtacaacgattacatcagaaacacaaccgaacgaaaaatttcattaacaatactattcgaaagaccaggatcctcgttatctattgctcccaaaagtattgcactactcccatgctagtcgccctgtactcctgtaagcctagccggaaccgacgatgatgttgttgatggggatgaaaatgagcttaacgaaaaagccgacgaagcccatgacgacaaacccgatcgccgtccgcgccgccaccttggtgaactccttgcggtcgggcttgtggcagcgcttgacgaggcggaccctgtccttggcgaagtcgcggaggggatccaccacgctgtcgatcgcgtccatggcgacggggcg

SEQ ID NO: 16752 - DNA, 487 bp, Zea mays
  Clone ID: LIB3279-232-Q6-N6-G3
ggggggggggaaaaatcccccccccaaaaaaaaaaaaaaaggggggggaaaaagggggggccccaaaaggatttccaaaaaaaggggggaaaaaaaaaaagggggcccgggggggggaaaaagggccatggggggggggaaaaaaaaaaccctttaagaaacccaaagggaggcccccggggggggggggtttaaaggggggggggatttgacccttcggggttccgggaaccacaagggggggccgacccgggggggggccccggggggggccccgggggcccccccggaaatccgggccgggccccggggggggaccaaatttcccttaagggggggggttaaaaaggggggggaaaaaagggaaaaaggggtccccgggggaaaatggtctcccggcaaaaatcccaaaaaaaaaaaaaccgggaaaaaaaaaggaaaaaccggggggggccaaagggggggccaaacaaaaaaaagggggggg

SEQ ID NO: 16753 - DNA, 467 bp, Zea mays
  Clone ID: LIB3279-232-Q6-N6-G4
ggggcccaaaaaagcctgactttaaagggggcctgggcccactaaaagggaaaaaaaagtgggcctttactccctaccccggtaaagtttttctttaaactccttttcccaatggccctttttcccctttttggaaaaaggggggggcccaatttttttttttggattttttttggttttggattcgaggccaaacccaaccagggactgatctcgacgggggtcctaaaaacaaccggtactggtaaaaaattcccccgaaaattgacaaaaaagggcttcctaaaaccccattttaaaaaaattggaaaaaaaccccccccttttgctccaaattttttatttctccaccggttgggccaaaacccgaagttaccctgggctgaaattaccccctccttgggtaaaatccaagggtcccgggggtcgggccaccaccccattgggggggggtggtccaagaaaaa

SEQ ID NO: 16754 - DNA, 549 bp, Zea mays
  Clone ID: LIB3279-232-Q6-N6-G5
gagccagcaagctagcattttatttagtaaaatcgttcacccgccggtacccaatcttttcagttttacacagttgccgtcttgaggctgttgcccttctcctgtaggctcacgagtaggctgtcaaagctcttcttgaaggagtccacaccttccagctcaagctggtttccgacctcgccccagtcaatgccaagcttctccaaggggctgtatacaccttccgcctgggacacattcgcatcaactgtcctcgagacagtgccggggtctatgaatgcgtgcaaagcttggtcgggcatcgtgttgaccgtgtcaggtccaatgagactgtcgatgtaaagagtgtcgggataagctgggttcttgacaccgggggatgcccacaacaacctctgtttcttggcacctttcttggccaacgcctcccacctcgggccagagaatttcttctggtagagccgatttgctagtttggcctgtgcgacggcagccttccctctcaaggcaagtgcctcaggtgttccaatcttttcaagcattttgtcg

SEQ ID NO: 16755 - DNA, 616 bp, Zea mays
  Clone ID: LIB3279-232-Q6-N6-G6
aaacgggaatttcagttctcatagcattatcatgaatctcagaacataacaggtgaaacacgaatcaagcagaggcgccatggggttcacagatccacacctaaaccgctaaattaaactgcgagcgatacatgataaactaagaccaccactcagatcaccaccatcttattcagatccaaaggaacggacgcagggggagtcgacgatgacggagggagggcggccgaacagaccagatcagagagatctaggagagctgtccgcagtcagcgaccttgaccaccttggaggtggagccgttgcgggtgcccaccttctcgatggccttgacgacgtccatgccctcgacgacctggccgaagacgacgtgcttgccgtcgagccaaggggtcgcgacggtgcagatgaagaactgggagccgttggtgttgggcccggcgttggccatggagagcacaccgggggcggtgtgcttgcgcacgaacttctcgtcggggaacttctcgccgtagatggactcgccgccggtgccgttgccgcgggtgaagtcgccgccctggcacatgaactcggggatgacgcggtggaaggtggagcccttgtagtggagcgg

SEQ ID NO: 16756 - DNA, 586 bp, Zea mays
  Clone ID: LIB3279-232-Q6-N6-G7
gaaacaatagagatcttagcaaaactttgcacgacaaggtacaataagtagtaacatgttcagatgattgcacggacacggaacaatctccaaattatagtcgaaaagcaccagcctagaagagagatttcttttgaattaaaaagacatcattctatagactactcatggaacatagtctataaactcaggctgctgggaaggccttctttccagcagctgcggatccagctggaatgactttaacgacattgaacctcacagtttttgacaggggcctgcactggccaatgatgacatggtcaccttccttcacacggaagcatggggagatgtgagcaggaatgttggagtgcctcttctcatacctctggtatttctttacaaagtggaggtagttcctgcgaacaatgatagttctgttcatcttagcactgtggcatgtcccagcaataattctgcctctgatagaaacagttccagtgaatgggcatttcttgtcaatgtaggtcccttcaattgcttccctgggagtcttgaagccaagccaatgctcttccagaatcggttgccgcccttgccaggc

SEQ ID NO: 16757 - DNA, 507 bp, Zea mays
  Clone ID: LIB3279-232-Q6-N6-G8
gcaataaaaaaaatcttttgacgccaacagcaatagccacatgagttcataacaccagaacagaagaactagccaattatcaaaaagattcaaataagtttgccagctcgtttgaactggtgaagggacaaaaattctttttagtaaccgcccttgagatcggtgaccacatcataaggaataggggtgactggctcgaggggagcaccctcaaccatgaagccaggtttgggtcccacaggctgccttttggggctgatcacctcaccgggggccttggcatccgccttgagctgggcattcttgggtttcctcaagcggaactcctccgggcaacgggagggctgcacatgctccacgcggacatggatccgcttcctgatgatgcggccattaacctgcttgttgatctcaacccccatggcgcgcttggtgacgttccaaacgctcccgatgcggccgtggtagaacttgtgcggcatgcccttgtgcacggggccgttaacc

SEQ ID NO: 16758 - DNA, 588 bp, Zea mays
  Clone ID: LIB3279-232-Q6-N6-H1
ctcaagtacaactatattattagtactaggagctggatcgatctttggtccgatccagtccgtaatccaccagagaaaagggaaacgtctaggcgggtgctagattagcagcctcagcatagcgcgcgcaaaagccttctccttccttcaatatacccggagagaggcctcgtcttcatcttcgtcttcatcctcctcttcgtcgtcgtcgcgcaaaaaaaaaacaaggcaaaaaaaccaaatcgacagtaccgtaattaattatccaatagctagccgcgcgcgcgctagctgttcatcctcagaactggccgccctcgaaggtctggctgaactgccagccagcggggacggcgccgttgctggtgacggtgcggccgtcgctggcggtgacctggaacgagagcgcctgcctgtccaggtacgagttgctctgccagttctggccccagttccgggacatgggctgccaccccgtgcgggagccccggatggagacggagcgcacgtcgccggcgcccgccacgttggtcaccagcaccaggttgaagtaggagtgcccgttgatggtgaaccggatgccgccct

SEQ ID NO: 16759 - DNA, 103 bp, Zea mays
  Clone ID: LIB3279-232-Q6-N6-H11
ctctctctctctctctctctctctctctctctctctctctctctctctctctctctctctctctctctctctctctctctctctctctctctctctctctctc

SEQ ID NO: 16760 - DNA, 537 bp, Zea mays
  unsure (1)..(537): unsure at all n locations; Clone ID: LIB3279-232-Q6-N6-H2
cttttctctctattctttctttttctctttttttttttctgggaaatcacaaaacaggttcctgacagctttccaattttatttcaaacaacgcctattggtacataggatcccaccttgtcaccggcctttacatgtgagactcgttgtatgttaacaggtgctcacaacattgaaaccctaagcctggggggccctgcccagggcgtgcaaagagggcgaaaggtaacatttttcgcacggacctccccgataaatgcgcattaaacaaaacctgccatgcccgataactaaaggaatgagccttctcgctcagagaggacagatggagacagggcatcagcgttgccagggacctaccaagcgggcacctttttgggcgattgggcggcagcggccttcttggggaaatttttatcttggccttccttgggagcagccacagcgggtttattggggagcagaacatggttaacgttgggcaaaaccccgagctgtgctatggtgacgccggtcccaaaatacttaanatagtcc

SEQ ID NO: 16761 - DNA, 591 bp, Zea mays
  Clone ID: LIB3279-232-Q6-N6-H3
gtccgcaatcgcgcaaattattggattttaaagtacaataagacagcaaagtttccatcgagtcacacaaaccccacatggcaatgccaacacacgccttcaagcatataacagtagtatttacgaatctaccaaacatgagtagcagtccacaggacaatgggtcattgcggctcaacagcataagcctgaatcgcatctgataaagcctgaaacaacctctcagccgcgggccttaagctcggcgaggcggcgagaaaggtcatcctcgtcgactttctccttatccttggcggcagggatggcgtgggcggctgcctgcggcagaccgacggagacctcgagcccgtagtcgtccgcgacctgctgcatgaggctgttgacctcggtctccggcgtggagagggaggtggagccggccatggcgccctccatgaactcggcctggacctccatgttgacgaactggcgctcgaaattgtccatggtctcggacatcttctggaggttcccggtggcgagcgaggagtcgagcgacttgacgatggactgcatggacttgccgatgacctgcatcttggcctgcgtgtc

SEQ ID NO: 16762 - DNA, 631 bp, Zea mays
  Clone ID: LIB3279-232-Q6-N6-H4
cgagcggcgccctttttttttttttttcttcaaaatgatgtacatggatcacttcattcgccaatgatcagtaaatcggccaaacaacccaacccaaccacaaacacgcacatgctaacggtacatgagaaagatgctgcagacagcaaggaactacgagttcccatctgctgatcatcattcgatcggggcctgtagcatcgccggtagcccatgaaacgacatccacataatattgtggctgaagtccattgttcatggcagcagcttctcttcacaaatgacacggattatgtgttagcatgtgtacagactgcgggaacagcagcagcaaaatgcccttcgccgctgctgtggccttggagcttgatgacggcgctaagactgagtagctcttagcgctccatgggcagctgatatccaatctcggtgccagcagggggaagaacgccccatctaattctgtgtgtctagtatgtcgtcagtcagctcatgatttcctggaagacgagagcaagctcttgtgcagcatttgcaactgccccttttcttcttgtaagagatgcaagcttatttttggcattctccaattcaatgaagcataaattgcagcgctccctcctttgctctg

SEQ ID NO: 16763 - DNA, 586 bp, Zea mays
  Clone ID: LIB3279-232-Q6-N6-H6
cgaaactagagcaggacacatcccatccacagatctagacacgagcatgctacagcacacagtgcaaatgaagtccctactttctaagacttcttgggggacttggcgcccttcttgggggacttgggctccttgctgccggcgctggccgccttctccgccgccttcttgggcaggagcacggagtggatgttggggaggacgccgccgtgcgcgatggtgacgcctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttcttcaggtagcgcccgatccggccgacggggaactgcagcccggccttgacggaccgcgtcaccgacttcttcctggggccgcctgccttgcgcccggccgcacccttcttccccttgctaccggctccgctggcgtccatggctacaggtgctgctgcgactggcgagc

SEQ ID NO: 16764 - DNA, 609 bp, Zea mays
  Clone ID: LIB3279-232-Q6-N6-H7
agctgcgaacaaaaaccttgctcattcttctctcgtctcgtttcatagcgggagcaaccaaagggaacaacaggggtaccaacacctaatccaaaggtagaacggacactaacacggtgacagaagcgaacggtaacacgatactatagatagataagataactcggccgaagccaggatgggcccacacatcagtccctccagccgccgccgccgccgccgtagccgccaccaccaccctcgcgccgaccgccgtagccgccaccgcctccgtagccgccgccaccaccctcgcgccgaccgccgtagccgccaccgccgccataaccgccgtcacggcgcccgccaccatagccgccgccgccgcgaccgccgccgtagccaccgccgccaccgccaccgccacgggactgggcctggttaacggtgatgttacggccgtcgagctccttgccgttcatgttctcgatagcgtcgagcatggagttctcggaggagaaggtaacgaagccgaagccgcgagacctccccgtctcccggtcggtgatgaccttggagtcgaggatctcgccgtaggaggcgaaggcattctccagcgactcgttgctg

SEQ ID NO: 16765 - DNA, 625 bp, Zea mays
  Clone ID: LIB3279-232-Q6-N6-H9
ccctctttttctttttttttctttttcttttttttttttttttttttcttcgttgggcaacacgaatcatcagtcttttaccaagatcgcttcgggacgaagcgggccacgaactaccacacaaaatagacttgtaaagccgtttttacactacttcgccacgccgtctaaaagcgaacaaacagcataaagttacaaattgcactcctccatccctccgccgccactggggccgggcgcgagatacgcctacgcgcgctcgccggggatgcggcgggcgagctggatgtctttgggcatgatggggacccgcttggcgtggatggcgcaaaggttggtgtcctcaaacagaccgacgaggtaggcctcgggggcttcctggagggccaggacggcgtggctctggaaccgcagatccgtcttgaagtcctgagcgatctcacggaccaggcgctggaagggcaacttccggatgagcagctccgtgctcttctggtacttgcggatctcgcgcagcgccacggggccgggcctgtacctgtggggctttttcacgccgccggtcgtgggcgccgacttcctcgccgccttggtggggagctgcttgcgcggggccttgcctccg

SEQ ID NO: 16766 - DNA, 648 bp, Zea mays
  Clone ID: LIB3279-234-Q6-K6-A1
gtgacgagcccaccgccaccggcaagtcccctccgccgtccttcagtactcggaagaaggcgaggcgcccaaccgagagcaccaggggaaaggaagtgcgcctaggcatcgacatggaggacttctacgtcacgatcccctacggcctgctgctcgtagccggcggcgtagccggctacatgaagcgcggcagcgccgcgtctctggtcgccgggggcggattcggtgctgcgctccttctcgctggtgcgctcagcgcctgggccttcgcgcacgccggaggtggcgctgccgccatctttgccaccgtccttcagatcgtttgtgctgtgctattgactgttgttatgggaataagatatgtcaaaacacaaaagataatgcctgctggaattgtcgcttctatcagtgcactcgtactgatattttacgtgtacaagatatctactggtggcaacaaggattatatgtcggtgagtgccgagtgaatctgggcgtgtggtgttccgtgtacatgtttgtacggcagctaaatgtgaagacaacaaaatcatttgtgtatcaattgtattttagtgaggcaaacactgtaccaaacaatgatggcacaagttagttaagatgtggatgtggacaccatggtcagtt

SEQ ID NO: 16767 - DNA, 273 bp, Zea mays
  Clone ID: LIB3279-234-Q6-K6-A10
cggacgcgtggggtttggtgtagctccaatggctacttttaaaaacaagtcattatgtactggtatatggtgcttcaccccacatgtccagcgagtataccattcaaatatatagtttctatacctatctaagtaccttatatggtgccatgcctggtgacacaccatgcatgtctaatgagtacccaacctcttagacacaatttggagcctctatggctacctggtccgtgccatgtttgggggacacatcagacatggctagtgagtact

SEQ ID NO: 16768 - DNA, 386 bp, Zea mays
  Clone ID: LIB3279-234-Q6-K6-A11
tcttcatcatggatccagctacttggagcacctcaatttcttgtctgctataagggctcaaggtgcatccggaccatctgtgaacttaagtgacggcctactatctgttgccgtcggtgtggctgggcaattatcaatcgagcagggccggtttgtaaccatggaagaggtcttaggtttgtagcctggtgataatccaggcatcctaatgtactgtaaaaccttttgtgtattattaggtacatggacttaagagtgctgcggactgacgagtttatgcaaagttaggataacattatataacatgatgcatttgaaatagaggaatatgatgattatcttcaaagaaaaaaaaaaatggataaaggtaaattaaaatatttctt

SEQ ID NO: 16769 - DNA, 637 bp, Zea mays
  Clone ID: LIB3279-234-Q6-K6-A2
gcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagattggcaagaggcaggtcatgatcaggccgtcatccaaggtcatcatcaagttcctgacggtcatgcagcgccatggctacattggagagttcgagtacgttgatgaccaccgatcgggcaagattgtggtcgaactcaacgggaggctgaacaagtgcggcgtcatcagccctcgctttgatattggcgtgaaagacatcgagggatggactgcaaggctgctcccgtccaggcagttcggatacatcgtcctcacgacttcggcaggcatcatggaccacgaggaggcccgccggaagagcgtcggaggcaaggttctaggtttcttctattgaagaagctgagaatctttgttatggcctgcctgcctgtcttactctctcagactagagtacctgttattttactttaatatgtctctctcagactagagagccttcttttacttgaatattggttactgcattggtctttcactttaaaatcggtgactgcattgatcg

SEQ ID NO: 16770 - DNA, 645 bp, Zea mays
  Clone ID: LIB3279-234-Q6-K6-A3
gtttcgctgtccgcctcagcccgccgcaaggagagttcaggagacatcttcgagaagctgaaatggctcctaaagctgctcctgccaagaagggtgatgccaagacccaggccttgaaggttgccaaggctgtgaagtctggggcagccaagaagaagaccaagaagatccgcacgtctgtgacatttcaccgccccacgaccctgaagaaggctagggaccccaagtacccacgaatcagcactaccggaaggaacaagcttgatcagtaccaaattctcaagtacccccttaccacagaatcagcgatgaagaagattgaagataacaacactctggtcttcattgttgacctcaaggcagacaagaagaagatcaaggctgccgtcaagaagatgtatgacatccaggcaaagaaggtcaacaccttgatcaggcctgatgggaagaagaaggcttacgtgaagctgactcccgactatgatgctcttgatgtggccaacaaaatcggcatcatctaagtgctgcattaggcatcctagttcatctgttgtgtcctagttctatgtgaaaccagagttttgtagctatggctctcaatcggtccattaccatgtgttatgcacacttctgaatttgatatca

SEQ ID NO: 16771 - DNA, 540 bp, Zea mays
  unsure (1)..(540): unsure at all n locations; Clone ID: LIB3279-234-Q6-K6-A5
ctagttcttgttagatgataattcgagcatcccgttctccgtggatgatatcaccaactcaatgcaggagaaggacttcacggatatcaaaccggctgatgagctactcgagaaccctgccttccagtttttacaggattagcgctagtgaagtcctcgagcattttatgctgctagatatcttgtcagatcatttattgatttgttgtatattttttggatcttttctaccacatgtgcctttttttagttatcttatccttttcagctagcttttgtaaaaattcatataggtatttgttagggttgggatgggatttccgcccttacagttagaaaaggccttatcttttaaagcggggcaaatgattctttgtagggcaacatgaaatcaatccttttacccaagggtgtggtgagaaggggtagatgcaatgtttgtagcctctcccagttatagattggtgtaattatatactgtaaatcaacagtgcaatgggaaaagaagganagctatatagcaaggtgcagtatgttgtc

SEQ ID NO: 16772 - DNA, 626 bp, Zea mays
  Clone ID: LIB3279-234-Q6-K6-A6
cctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaagattagattgcactacgcttatattttagtattgaactcgttgcattttgatacctgtacccgtagtttcgcaaatgtcccatgttatggtgtggtatggttaatttgaagaatccttatgtactgaatctctggcaaaagctatgttgtggacagaagtgtaacgtgcccgattttttgc

SEQ ID NO: 16773 - DNA, 666 bp, Zea mays
  Clone ID: LIB3279-234-Q6-K6-A8
tgataatgctgcatttagacagaaagaaatatttgcactgcgtgatacaactcaggaagaccccagggaggtcgctgctgccaaagcagatttgaactatattggtcttgatggagagattggttgcatggtgaatggagcaggattggccatggcgaccatggatattataaagttgcatggtggtacgcccgccaattttcttgatgtcggtggaagtgcatcagaggggcaggttgtggaagcttttaagatactgacttcagatgatagagtgaaggcaattctagtgaacatttttggtggcattatgaaatgtgatgtgatagcaagtggaattgttaatgctgccaaacaggttgacctgaaagttcctgttgttgttcggttggaaggcaccaatgtagaccaaggaaagaggattcttaaggaaagtggaatgactttgatcactgcagaagatcttgatgatgcggcagagaaagctgtaaaagcatccgtcaaataactagtgtatcaatctgaagtttctttttttttcactggtacaagatgagcagtgctcttttacggatttcgatttggagcagaagtcgtgaactgcaacgtttttgaaatggtttgactctgatgtcactcaagcgcgatggacaggtggagcatgct

SEQ ID NO: 16774 - DNA, 460 bp, Zea mays
  Clone ID: LIB3279-234-Q6-K6-A9
ggtttcaataatcccgaaactgtgattccacagcagagcagaaacggaagagaagaccccatatatatgttcttcgggatactgcgctacgcagcgttcgattacaactcaacataaatacgattggtctgcatcatgtccggtggaagcccagcatgtccggtggaaattaagccatggccacgatccgactgaatccacaggatcagacttcagctgcttccttcacttgtccacttggtattgtttctcttctttataatagcggttgaaacccaatgtatccttgatctcctgaaaagatggcaggacgctaggtggaggtacaccgccgtcttttatcgcaactagagcatcctgcattgcacgcattgataccccaactaaggataaaggatatactacaagcctgaaaccaatttcctcaagttcagcaggggctaatatggggagtttacca

SEQ ID NO: 16775 - DNA, 283 bp, Zea mays
  unsure (1)..(283): unsure at all n locations; Clone ID: LIB3279-234-Q6-K6-B1
caacaacacactccccactatcatcaccaagttcaagcgccagggcctcaatgttgttgatgttgtcgccctctcaggtggtcacaccattggtatgtctcggtgcactagtttccggcagaggctatacaaccagacaggcaatggcatggctgacagcacactggatgtatcctacgccgcaaagctgaggcagggatgcccccgctctggtggtgacaacaacctcttccncttggacttcatcacccctgccaagtttgacaatntttactacaagaac

SEQ ID NO: 16776 - DNA, 581 bp, Zea mays
  Clone ID: LIB3279-234-Q6-K6-B10
cggacgcgtgggcggacgcgtgggctcttctccacctccacctccacccatggcggcctccaccttcagcggcgacgagacggcgcccttcttcggcttcctcggcgccgccgccgcgctcgtcttctcctgcatgggcgccgcctacgggacggccaagagcggcgtcggcgtcgcctccatgggcgtcatgcgccccgagctcgtcatgaagtccatcgtccccgtcgtcatggcgggagtactcggcatctacggcctcatcatcgccgtcatcatctccaccgggatcaaccccaaggccaagccctacttcctcttcgacggctacgcgcacctctcctccggactcgcctgcggcctcgctggcctcgctgccggcatggccatcggcatcgtcggagacgccggagttagggcgaatgcacagcagccaaagttgtttgtgggcatgattctgatccttatcttcgcagaagctcttgctctgtacggtctcatcgtcggtatcattctctcatcccgtgcaggccaatctcgcgccgattagaaggcttgatatacgccacactgagtcatct

SEQ ID NO: 16777 - DNA, 609 bp, Zea mays
  Clone ID: LIB3279-234-Q6-K6-B11
aaaagttccctcccttattacaatcttcctcagcgccgccgctcccagacaccgagcccgactgcccaaccccgatccggcgatccgtctccttcttttcctcctttctgccgtccccgatcactcgcaaccatggcggcggcagcaggcggaggcgcggtgcgtgctctgtcccagaaggagcaggacatacagatgatgctcgccgccgacgtccaccttggcaccaagaactgcgatttccagacggagcgctatgtctttaagcgccgttccgacggcatctacatcatcaatcttggcaagacatgggataaactccagcttgcagcgagggttatcgttgccatcgagaacccgcaggacatcatcgtccagtctgcccgcccatatggccagcgtgctgtcctcaagttcgctcagtacactggcgcccatgccatcgctgggaggcacacccctggtacattcactaatcagctccagacctccttcagcgagcctcgactgctcatccttactgacccaaggactgaccatcagccaatcaaggagtctgctctggggaacatcccgaccattgccttttgtgacactgactcttccatg

SEQ ID NO: 16778 - DNA, 656 bp, Zea mays
  Clone ID: LIB3279-234-Q6-K6-B12
ggagcagcagcagcaggcggtgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgacaagacctaccctgctgggttcatggatgtcatttccatccctaagacaatggagaactacaggctgctttatgacaccaagggccgcttccgtcttcacccaatcagggatgaggatgccaagttcaagctctgcaaggtgaggtccgttcagtttggccagaagggcatcccctacctgaacacctacgacggccgtaccatccgctaccccgacccgctcattaaggccaacgacaccatcaagatcgatctggagaccaacaagatcatggacttcattaagtttgacgtcggcaacgtggtcatggtgaccggcgggaggaacaccgggcgtgtaggtgtgatcaagaacagggagaag

SEQ ID NO: 16779 - DNA, 512 bp, Zea mays
  Clone ID: LIB3279-234-Q6-K6-B2
gggttttaaactttccccccgatccgcctcgccgccggcgtcgtcctccgccggaaatccaccaccctacacccagccggagacgactatggtgggtttcggctcgatggcgggctacgggatccagtcgatgctcaaggaaggccaccgccacctctccgggctcgaggaggccgttctcaagaacatcgacgcctgccgcgagctgtccgccattacgcgcacctctctcggcccgaacggaatgaacaaaatggttatcaatcacttggacaagctgtttgtcacaaacgatgctgccaccattgtgaatgagctcgaagttcagcaccctgctgctaagattctggtactggctggcagggctcaacaggaggagattggggatggggccaatctcaccatatcgtttgccggtgaactgcttgagaaggctgaggagctcatcaggatgggcttgcatccaagtgagatcatcattggctacactaaagccatcaacaagacaattg

SEQ ID NO: 16780 - DNA, 516 bp, Zea mays
  Clone ID: LIB3279-234-Q6-K6-B3
gcgtcgaccgaccttctcattcctgctcctcgctccttcttgatccagccaagccagggatcgctgtcggctcggagacaccattcgaatcgaaggccgacccggagcgtccaagacctacccgtacaggctggcaccgccgtaagaacggcttcatcgcatcaagaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctg

SEQ ID NO: 16781 - DNA, 188 bp, Zea mays
  Clone ID: LIB3279-234-Q6-K6-B4
ctctactctatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggcccgatcgggcg

SEQ ID NO: 16782 - DNA, 371 bp, Zea mays
  unsure (1)..(371): unsure at all n locations; Clone ID: LIB3279-234-Q6-K6-B5
caganaccatgatcggcttcatctccctgaagaagttcgcctacgcgtccgttctcgtgcccctgcttccagccagcataatcttcgcctacgtctgccacatgcgcttctacccggcgttcgccaagactcccctggaggtggtggtgcggcacgacctgaaggagactccgaacatggaggccatctacaccgcgtacataccgccgtgcttgaagcctgataagctcgaagatctggacgcgttcgaggacgcccagtcgcgcgccacctccagagtccccgtctattttaggctgtgcacaatcgttcgactttcccgccggaaagactttgaaagaaatttctggttcactttgtcattacatttc

SEQ ID NO: 16783 - DNA, 533 bp, Zea mays
  Clone ID: LIB3279-234-Q6-K6-B6
ctttggccttattcaattggggaaatgtgcacatgtgtgaagcaaggaagcgcatccctctcgatgaatctgctccaaaggaagtcatggctgctcagctccgcacagcttattattgggtgaaggagaggtatgctcttgcagggcacaaatatgaggaggcccttaaaatcaagccagacttctatgaagggcttcttgctttaggccagcaacacttcgagactgcaaagcttcattggtcatatgcactggcagataaggctgacctatctacctgggattctttggaaacattcaagctttttgatagcgctgagcagaacatgagggctgcaacagagatgtgggagaaggtggaagaacagagaatggtagagttaaaagaaccaggcgcatgtgataaggatggggtactgaggaaaaggcagcacggtgcaggtggtcaaccggagttgacaccagaagaggcagctgagcaggcagcagtaatgaggcaacagattcacctcttctggggtaatatgcttttc

SEQ ID NO: 16784 - DNA, 507 bp, Zea mays
  Clone ID: LIB3279-234-Q6-K6-B7
caagccccgtgccattgcccgaacgctccactctgttcgcgccattggaagagagggagaagttgcggggtgcacgccaggggggatttcctccaccgtacgtcctctagcgggtgctatggcacttttggccgggtgtgtggatccaagcggaggcaggattggcgcctgcgaggccatagcgtgtcgggaattgttcaccggagccaggagttcgcgccgtgaagctccccaccgtggtccgacctccgcgcgacacctctgccgacgaaccagtgaccgaggatccaagtgttcagtaggtgaagttgctgagcaggagcttattgaaggagaagaacaggtggtccagggggagccttacaacgaggagtacgagcttatctaggtggcatctcccagtcagcttgatggcgctaaggaataatacttagttctctttgttgttctcatttttttgtaagacttccgctatgtaataatgatatttatgacatttatctctat

SEQ ID NO: 16785 - DNA, 414 bp, Zea mays
  unsure (1)..(414): unsure at all n locations; Clone ID: LIB3279-234-Q6-K6-B8
cgcttccaagatgtcgaagcgagggcgtggaggttcggctggtaacaagttccggatgtcactgggtctaccagtggcagctactgtgaactgtgccgataacactggggccaagaacctgtacatcatttctgtgaagggaatcaagggtcgccttaacaggcttccttctgcctgtgttggtgacatggttatggcgaccgtgaagaagggaaagcctgaccttagaaagaaggtgatgccagctgttattgtgaggcagcgcaagccatggcgccgaaaggatggtgtctacatgtactttgaagacaatgctggagtgattgtgaacccaaagggagagatgaaaggttctgccatcactgngcccatcggaaaggagtgcgctgatctctggcccaggattgctagcgc

SEQ ID NO: 16786 - DNA, 579 bp, Zea mays
  Clone ID: LIB3279-234-Q6-K6-B9
aattacgttctatttttcaaactgtacaagaaggcacccaatttgaactcatgcctcatggatctatatgtggagcggatgcgcttcgaagctatgaaatgcatgtctaggtcatatcgcccaactgtacctgtgggatatgttgcacagattttggggttcatgagaactgatacaggctgtgcaaccaatggggatgatggattagaagaatgcgaaaaatggttgaaagcgcatgggatagttctttcagaaggtaacagtggggaattacaaatagacatgaaggcttcgtcttctacactttacatgccagagccagagaatgcggttgcacatggtgatgcatcacttgctgttgatgactttttggcacggactgacgggcatcttaaaaggtgcagcagcgatgagccaacggtggatactccgtagtgtagtatattggtgctgctgtggcagtcgtgccgagatgtggatgcactgcacttctcccgtagaaactgcaaagggggcatgaaatggagctgcccaacgaagctcgcggagctaagagagtcgaaacaactgaacaaggat

SEQ ID NO: 16787 - DNA, 396 bp, Zea mays
  Clone ID: LIB3279-234-Q6-K6-C10
cgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggacacaaactgctgcctgtatggactcgtgcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatctatgatcttgtggctgcagcatgttcttgtc

SEQ ID NO: 16788 - DNA, 249 bp, Zea mays
  Clone ID: LIB3279-234-Q6-K6-C11
ctattattgatctctcttgagttgaagctaggtttcaagtatctcctaaggtttataggtgaaaaccagggatttttttttttgcactacaatctgtgacgttttaatacttgattactagttgttcatgcattgctattgtattcgcatatcccctaggtttaagagcaaggtttaagagcctttctaacaaggtgactcaatgatgtctcaaatttaaaatactacatttaaagtgttcaggtcgcc

SEQ ID NO: 16789 - DNA, 666 bp, Zea mays
  Clone ID: LIB3279-234-Q6-K6-C2
ataagagctgaagctcaatgccgcattgctgaggctgaaagggaatgcaaaatcacattagagaatgagaaaatgaagtatcatgaagaatacttagactcaataagaatactggaggagaagtggaaagtacatcagcaatcacccaagaaacaaaataaagaggctgagtctacatccaatgatactggagaagtgcataatttactgcagaatgagaaaatgctacgtcaatcggctgaagatgaggccagtgacctcaagaatcaaatatcacactggaaaaagctggaggctacagctacagctgagataataaaactacagaaaatgctagatgctgaagctagccagaaagagaaacttgaagaagaaataggtgttttgagaagccagttattgcagatgagtatggaagccgatgagacaagaagtcttgataaaggagatgggccaggaaaaatatttcctggtttagattcattggtgtctcagactcgaggttcacaacccagagagcaggacaatggacagaagcaaccaattgccaaactctttgaacaagttgggttacaaaagatattgtcattgcttgaatctgaagaccctgatgtccgcgttcatgcagtgaaagttgtcgcaaatctggcagctgaaggagctctg

SEQ ID NO: 16790 - DNA, 475 bp, Zea mays
  Clone ID: LIB3279-234-Q6-K6-C3
ctacgatgggacgctgatgccgcagacttcgctcggtaagagtcctacctcaaggacgatagacatgttgaacagcctttgccgcgacaggaacaacatggtcttccttgtgagcgcaaagagccggatgactctgaacgaatggttcttaccatgtgagagccttggactagcagctgaacacggctgcttcctcaggctgagaagagatgcagagtgggagacatgcgttccggtgatagactgcagctggaagcagatcgcagagcctgtgatgaagacctataccgagactacggacgggtcgactattgaggagaaggagactgccatcgtgtggtgctacgaggacgccgatccagatttcggatcctgccaggccaaggagctccacgaccatctggagagcgtgcttgcaaacgagccggtctcagtgaaagctggacccaacctcgtcgaggtgaaaccacagggc

SEQ ID NO: 16791 - DNA, 629 bp, Zea mays
  Clone ID: LIB3279-234-Q6-K6-C4
cggacgcgtgggcggcgtcactaagttctccgacctcacgccggcagagttccgccggacctacctcggcctccgcaagtcccggcgcgctctcctcagagaactcggggagtcggcgcacgaggcgcccgtgctccccaccgatggtctccccgacgatttcgactggagggaccacggcgccgtcggccccgtcaagaaccagggttcgtgcgggtcgtgctggtcgttcagcgcgtctggagcgctggagggtgcgcactacctcgcaactggcaagctggaggtgctttcggagcagcagttcgtcgactgtgaccacgagtgtgattcatcggagcctgattcatgtgattcgggttgcaatggtgggctaatgacgacggcattcagttatctccagaaggccggtggccttgagagtgagaaggattacccttacactgggagtgatggcaaatgcaagtttgacaagtccaagattgttgcttcagttcagaacttcagtgttgtgtctgtggacgaggctcaaatttctgctaacctcatcaaacatgggccattggcaatcggcatcaatgctgcctacatgcagacatacatcggaagcgtgtcatgcccatacatct

SEQ ID NO: 16792 - DNA, 103 bp, Zea mays
  Clone ID: LIB3279-234-Q6-K6-C5
agggaagggaggccttccaaggcaagaaagtgctcgttgtcggttgtgataacacctttccaaaaataatgttcatgcctacattgtttgttcgtcattgggt

SEQ ID NO: 16793 - DNA, 589 bp, Zea mays
  Clone ID: LIB3279-234-Q6-K6-C6
cttgcctgataaaaatgatgtctctgcatgggatgtcttgttatctaataagttcgactcagaaacatcacttcagaaactgccattggcagaatgctgggtgggtacagggacttcctgaacttattgataagggcagcaaaagctttgataaggttttttttggagatgctggttgaaaaatatatgattacttttggggggattttggttgttgggtttttggaacttggcaaacaacggtttaccaattcaggggccagaaccgttgttgttccagccaaaagggttttggggtttgtgttggaaaccatactgaagtattggcttcctttaatgcctttcgtaattgaaaaataagggcaggcttttccatacaaaaaacaagcactaatggttactccttggcctaccactgaccttcttaaaaattggaggtccatcaaacggttccagaattggcaatcatggttaaaaggaatcaaaattgttcaaccaaaatattttgttgagccagttaaacggatataagctcttgttgttgttactgcaaatgtcctgaatttgtatcaaggaagaagcaggtcct

SEQ ID NO: 16794 - DNA, 207 bp, Zea mays
  Clone ID: LIB3279-234-Q6-K6-C7
gttctgccatgccttctactgggatacctagggcaagctgcatttcttatggagaacttagataaaagtcagcaggtcttctttttgtccattccaagtcaggcattttggccagtggtattcatagctactctggcagcactaattgctagtcgggccatgacaactggtttattctcaactataaagcaagcaaccgctctgggc

SEQ ID NO: 16795 - DNA, 640 bp, Zea mays
  unsure (1)..(640): unsure at all n locations; Clone ID: LIB3279-234-Q6-K6-C8
aagcagaagaaaatcgagataacgagagctagggttttgattccagtactcacgagtcacgccgcatcctgtctccttctgcccctccctctcggcaccgcctccgccccctcattctctctcgcgtcatccggcggaggctcgaggaaactgaggccgggagcgccccgaagaatattctccacccagtcgccgacacccctgcgcgcgcgagagttaccattgtactgttgtagcttggcagttggttgactgtgtgacaactttgagctatgtcatattacgaaagaaggggtggagacaggggtagtggccgtattcaaggaagtggtgggcgaggtggacatgtcctgcgtggaagatcaggattggctccccgaggacttcttggggttaactcccgtccatctgcacgcactattgctaagtcatttagcagaaccaaagacatgacatggcgacctgatctatttagtgatagcatggcggctagtggaatagaaactggtacaaaattgtacatttcaaacttggactatggggtctctaatgaggatataaaggagctgttttcggaaagttgtcatttgaaacgctntgctgttcactacgatggttatgggccgccaaatggcactgc

SEQ ID NO: 16796 - DNA, 176 bp, Zea mays
  unsure (1)..(176): unsure at all n locations; Clone ID: LIB3279-234-Q6-K6-C9
gacatggtgaaagtgaagctgactaaacagccagtctaaaactcgattgattgggccaaattgccctggtatcattaagcctggtgagtgtaaaattggaatcatgccaggttacatccacaagcctgggcgtattgngatcgtatctcgttcttggtactttgacatttgaagcg

SEQ ID NO: 16797 - DNA, 176 bp, Zea mays
  Clone ID: LIB3279-234-Q6-K6-D1
agcgtccgaacaacactctcccaatattatcaccaagttcaagcgccagggcctaatgttgttgatgttgtcgccctctcaggtggtcacaccataggtatgtatcggagcactagtaaaccggcagaggctatacaaccagacaggcaatggcatggatgacagaacactggatg

SEQ ID NO: 16798 - DNA, 449 bp, Zea mays
  unsure (1)..(449): unsure at all n locations; Clone ID: LIB3279-234-Q6-K6-D10
ctcctcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggncatgtccatcatgaactctttcttcaacgacatcttcgagaagctggccggcgaggccgccaagctcgcgcgctacaacaagaagcccaccatcacctcccgcgagatccagacctccgtgcgcctcgtgctccccggaagctc

SEQ ID NO: 16799 - DNA, 586 bp, Zea mays
  Clone ID: LIB3279-234-Q6-K6-D11
ccgaaatcaaggtagcgtacaccgctgcagtttctagagccctctctgccactcgtgatcccactagtcacaatgcctgccctcgccaagcccgcctcccgcaccgccaagcccgccgcggctccgaagccgaagcctgccgccgccaagccgaaggcggccaccgctggtgcctcccacccgccttacttcgagatgatcaaggaggctatcacggcgctcaaggagaggaccggctccagctcgcaagcgatcgccaagtatgtgggggacaagcacggcgcgtctctgccggccaacttcaagaagatgctttccatccagctccgtgggtccgcagccaagggcaagctcgtgaaggtcaaggcttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtccc

SEQ ID NO: 16800 - DNA, 539 bp, Zea mays
  unsure (1)..(539): unsure at all n locations; Clone ID: LIB3279-234-Q6-K6-D12
ctcttctgctgcctctcgcctcgcgacctccgcttcgtcctcctcccgcagctgctcctgtttttgtttttgtcgatttttgtcgctggagcgaggattttttgaggaatatttcgggattttggggctatttttcggggacttttttttgggggggagggaggattttcgttattttctttttatttttgggaggcgccgcccggaactaaaggagggagatggggagagcgtgcgtgagctccaatggcgactgctcgtgtcgggaggcttagtaggacgactacgagcaggcgggcgcgtgcggggtgctgcgtgcatggaggccaagccgggggaagccagtgttgggcatgcgcctgcgcctatggcggcggcagcaccggttatggcggcgccaccactagaggagactgtgagcttccagcagccgctgccggcgccagccgcggcggcggagaggggcagctcgagcgccgtcctggtgccgccttttgctacngcggcaggaggcggcgcgatggcgctcgtgccggtgc

SEQ ID NO: 16801 - DNA, 564 bp, Zea mays
  Clone ID: LIB3279-234-Q6-K6-D2
cggacgcgtggggttctagatcgcgagcggctgccctttttttttttttttgcaccaagaacagtagaagagctagttgtaacattaagctgtctgccattacacatcatatacgtttgcttacagaagtgcaccctagacacacgaggagagcagcagtaaactaacagctgcattcttgttatattttttggtcatttcttacgtgcatgctatacaaaagaaacttctacagtagtacaactactcacgtttttttacttcgactttgacagacagaccacgacgccgacggcagctgcagccagtagcagatgctgctagagaggcagcagccttccatgtgagtcaccgagtccccatcaggggccggccagcgaacctagcgaggctggtggatcacgcgaggagcgctgctcttggggctgccggcgtacttggtcggcttctcggagtgcctgggtttctcccggaacccccgcggggcgtcgccgctcttcggggagcccaagttcagcgccttgagcaccgaatctgtcttaagggcggcggcggcggcggggg

SEQ ID NO: 16802 - DNA, 195 bp, Zea mays
  Clone ID: LIB3279-234-Q6-K6-D3
cccacgcgtccgcggacgcgtggggtgctgccttcgcttccctggtcagctgaattctgacctccggaagcttgcagtgaacctgatccccttcccacgtctgcacttcttcatggttggatttgctccactgacctcgcggggctcccagcagtaccgcgctctcaccgtgccagagctgacccagcagatgtg

SEQ ID NO: 16803 - DNA, 505 bp, Zea mays
  unsure (1)..(505): unsure at all n locations; Clone ID: LIB3279-234-Q6-K6-D4
gatttttgtacccgccggctgggcctcggcctcggcgtgcaagaaactagaaagaggagcagacaaacaaaatcgattagaattaaccccaggccagaaacccactctctctctcccccgattcctttcctcgtcctcgtcctcatccgtccaggggagcaaacaagcaagcaagtaaacgggcgaggagctggatagaggccggcgactcgaagcaaccgccgatcggagccgcggctgaggaggaggagcaagctcgagatggtgggtctcgtcggcggcagcacggcgcgggcggagcacgtcgtggccaacgccggaggagagacggagtacgtgcgccgnctgcaccgncacgcgccggccgagcaccagtgtacttccaccctcgtcaagcacatcaaggcgcccgtccacctcgtgtgggagctggtccggagcttcgaccagccgcagcggtacaagccgttcgtcagaaactgcgttgtgcgcggtgaccagctcg

SEQ ID NO: 16804 - DNA, 661 bp, Zea mays
  Clone ID: LIB3279-234-Q6-K6-D5
gccattcatcatcagagctagctagctcagagaagagaagagctgttgcgtagcgcgcgcgcgcgctgtgacgacgactgtgagtagcgagagagtgagtgagtggtgactatttcaagaacatcagctcggccgtttcttcgaccccgcgcccttttttggaactaactgaaccatgagaggcacgctggagtacctgtcggacctgctgggcggcggaagcagcagcagccggcgccggtacaacaggaggaggacgcagttccagacggtggagctcaaggtgcgcatggactgcgacggctgcgagatgaaggtcaggaacgccctctcccgcatgaaaggggtgcattccgtggagatcgaccggaagcagtccaaggtgacggtgcaggggtacgtggagcctcacaaggtggtcaagcgggtgcaggccacggggaagaaggcggccgagatctggccctacgtgccctacagcctcgtcgcgcacccttacgccgcgccggcctacgacaggaaggcgccgccgggctacgtgcgcagggtcgacgccgtcatgcccgtctccagctacggcggacccacggcgggccgcccgcaagaggagcggctcgtaacatgttcagcgacgccaaccccacgcatgctccatcatgtg

SEQ ID NO: 16805 - DNA, 375 bp, Zea mays
  Clone ID: LIB3279-234-Q6-K6-D6
gagacaaagccctccaatgctataagtattattgagaccgattgtgaggttgactttgctccaccacttgactacaaagaacctgagccagtaaaacctgctgttcctgcaagcacggagcctggtaccgacgttccagctgaagaagaaccaaagttcatccccttcactggttcaggaaggcgcttggatgggaagccttccaaagataaagatgtgctagcctcttcccctgcaaagcgacaagccaatgcgaccaacggtgtgcagccttcaacagccaccaaatcacagggcagttcattgcgttaggccccaggaaaacttggttttggctcttgggggagccgaaccgaaaagggacctggaaaggga

SEQ ID NO: 16806 - DNA, 117 bp, Zea mays
  Clone ID: LIB3279-234-Q6-K6-D7
cccacgcgtccggcctgaaatgaaactgattcaggctgctctgttcgtaggcgagaattctctctgtaaaattccttcattcatattttatggttcatgagcaccatcattgacgtg

SEQ ID NO: 16807 - DNA, 424 bp, Zea mays
  unsure (1)..(424): unsure at all n locations; Clone ID: LIB3279-234-Q6-K6-D8
cgagaaggaagaaaacggtgaaatgctctgctgtgctcatggtgggtcattgtcgccagtcgtcctgngaacctgcggaagatctgcattatttttttttcagaaagaaagagagaggagagaggaggtcgcctgccactgtagttctggtcccaaaggcttggcccggttgcccggcccggccagtgggtggcccccgccttccttttcttcgttcgtttttttttttttcgttttcttcctactcgtagtcgtaccaccagggtctggtccggggtcttgccccttcgctttggcgttgccccagttcctggttttttgagataatgacttcaacctgttttgagtcaaaaaaaaaaaaaaaaaaaaaaaaaaaaaaaaaaaaaaaaaaaaaaaaaaaaaaaanaaaaaaaaaaggggnggc

SEQ ID NO: 16808 - DNA, 650 bp, Zea mays
  Clone ID: LIB3279-234-Q6-K6-D9
cggacgcgtgggttactgctggctgctgctcgccattgctgaccacactcacagcagcctccctccccctcgccaccaaaagctagcccgttgcttgcaagcctcgccaactgccgctatatatacgcatacaagcgcgcgccgcgcacgcgcagcacgcaatcagaacagtggttgctggagagcgcgcgggccgggcaagggagcaaggacgagggatcgtcgatggtgttcttctgcttcctggtggagcagcggcggacggtgcggagcagcaagccggcggcgggggatctgctcgcgctgcggcgggtgcgccagcgtggcggacatggagaccgccaccagggtctgctacctgctaaccgtgcaccgccgcacctggcgcgccatcatctgcaccttctgcggcgccatgctcaagtcctaccgccactacaggctctactgactctcggccgatcgatggagttgttcgagtcggtggttggtggtggaacccccgccttcattcttcgcgggcctcgcggtttgctgtgaggtgtagggatgagctacttacggtactagctagggatctgttcttcctgatgagtcctctcctgactgggtatctggctcgcgactgctactagatttttttttggttt

SEQ ID NO: 16809 - DNA, 332 bp, Zea mays
  Clone ID: LIB3279-234-Q6-K6-E1
cggacgcgtgggcttctatggcgggaaggtccttgtgttcgatgacttccctgctgagaaggcaaaagacctgatgcaaatggccagcaagggttcatccgtagcccagaaccctggcctgctgcctccttccacagctgcaaccgttactgacagcaccaagatcgcagcagtgccagccgcaccaattgctgtggccaacgcccagaagagtgcagcagatataccgcaggctcccaaggcatctcttcgcaggttccttgagaagagaaaggatcgccttactgcgaaagcaccgtacccgggttccccttcagatgttacacctgtga

SEQ ID NO: 16810 - DNA, 478 bp, Zea mays
  unsure (1)..(478): unsure at all n locations; Clone ID: LIB3279-234-Q6-K6-E10
gaaccgcttcagttatatcgtgatcaacatgtcgcgttagaatatcttctagatttggattttgatgtgttttctaaatacaaggatgatcatctggttggcggggcgacgtcgagcacctacgccatgactgcaacattctagtgaacaacgtcatggacatgagacacattgtggcgaaggtgcgctctcgaggacaacaggtctcaagaccctcacgcatgaggtgatgggcatgctgatcgacaagaccaaacaaatgacgctcatttggtgggccagacctctattgtccctagtaggtctagtacaccatcgtcgattatgtgtcctacgcgattggtcggctgctgctcactagggagcacacgaaatacatagatatcgtcgttgcaacaatctcgttctatattatcttcgtgtgactntcatatctactgtgatgcgaatcgaattagtgatttctcagatgttggtc

SEQ ID NO: 16811 - DNA, 657 bp, Zea mays
  Clone ID: LIB3279-234-Q6-K6-E11
cacaccgcgcccagctccgaggtgatcttccggcggccggcgagatgagccgtggcacaggcgcgggctatgaccgccacatcaccatcttctcccccgagggacgcctgtaccaagtcgagtacgcgttcaaggcggtgaagtcggcgggtgtcacgtcgatcggcgtccgcggcgcggactccgtctgcgttgttacgcagaagaaagtcccggataagttgctggatcagacgagcgtgacacacctgttcccgatcaccaagtacgtcggattgcttgccactggccttacagctgatgctaggtcattggtttcccaagcaaggaatgaagcagctgagtttcgtttcaaatggggctacgagatgccagttgatgtgttagcaaaatggattgctgacaaagctcaagtttacacgcagcatgcatacatgagaccccttggagtagttgctatggtcttgggctacgatgaagagaaaaatgcccaactactcaaatgcgaccctgctggtcacttctttggacataaggcaactagtgccgggctcaaggagcaggaagcaataaattttctggagaagaaaatgaaggatgacccgaaattcacctatgacgaaactgtgcagattgcaatatctgcgttgcaatcag

SEQ ID NO: 16812 - DNA, 407 bp, Zea mays
  Clone ID: LIB3279-234-Q6-K6-E2
ggcactcaaggttatcatgcgaagctatgggaaccccaacgccaattttgctacaaactcttataactcctggatatggcattgatgaaccaactgctgccactgatactgatgattagcttggaactggtgcaacgcatggttcttggggtgcctatgacttgcgaagggcgaccgggcgtagatcagtgctgccaattcctcaggcctttcacggcagctctggccatgccttgatgatggttagcggtggatcagatgttgaacaggtaggggcacaccgtattagagtgaatatgcgcacacatcatgctttagtttagcttctatcggcctgtgcaagggaacatatatctgttgcatccagtgtcaatcgtattggaacgttatctatcgagcatgaatat

SEQ ID NO: 16813 - DNA, 362 bp, Zea mays
  Clone ID: LIB3279-234-Q6-K6-E3
cgcacggatgatccacacctggatcctgagctggtacttcggggggtactccaggacgttccgcagcatggccaacagtctggccaagctgttcgccgtgctggtctgatttataccgtgatgtataccggttggtcgagtggctggggatgtgacttcggatatgagcgtgctgatgtcctgtctgtactcgtagtgaatttggaagtgattatgatagaaattatgttcaaaatgatgtgcagattgttgttcagatagctgttatatgaaatgtaatatgagatagaatatctaactgtaattcatgcatcattgcatcactaatctattcactacactctttatttaacgctcttcat

SEQ ID NO: 16814 - DNA, 614 bp, Zea mays
  Clone ID: LIB3279-234-Q6-K6-E4
cggacgcgtggggcctgaaatacattggcattgagctgtggcaggttaaatcaggcactttgtttgacaacatcatcatcactgatgatcctgcgttggccaagacttttgcagaggagacatggggcaagcacaaggaggcagagaagactgctttcgatgaggctgagaaaaagaaggaagaagaggaagccgccaagggtggcgatgatgacgatgatgacctagaggatgaggcagacgatgacaaggcagacgatgacaaggccgactctgatgccgaggatgacaaggactctgaggagcacgacgagctctagatgatgagtatgatagaggtggccactgacattggtgccgttggcctggatttatcagctcttccattttgttctccttttctgttatcagaaactttaggacattgttaagaagctgagggacagtatgggtcgtagcgcttagtcatttttcccattaaaatcgatagcactgcaggaagatcttttcccacaattgttatatttcatcctgatgttagatgtcagctgtgttagtttattgagaactgtttaattagtcaaaaaagaagaataatacaagcatttgggttc

SEQ ID NO: 16815 - DNA, 559 bp, Zea mays
  Clone ID: LIB3279-234-Q6-K6-E5
tgcaactcaagagcttcggctgccttggttgtttccgggtttaaccttcgtaagcctagtaatgttccttttttatttccaaatttctgtcagggcgactttcccaagcaaaccgaagccagcaccaagcaccgacaaaatcaaagctccaagcaaaacggcagcaggcaacaggaaacccgcgaaggctggaaccaagcaggggagcattatgtcattcttcaagaaagcatgagccagcgcggtgcgcaccaaaacgagacaggactaggttcagcaaactgtctgctgccgcgcttactgaaccaggtcgttagccaggcatctgaactggtagccctacggctctttacctgaatatcgtcaggccagcgagcaagaagggctccaagcagagagcacgtctgttagttcagtgattatcttgctgtaggtgtccatatagttgtactgagaggtactcacagcctgtttgcactttttgggcggttctgttgtgttgtgtggaagtcaaagggagaaacgctttgggtttctccatccggtattgcaacctact

SEQ ID NO: 16816 - DNA, 426 bp, Zea mays
  Clone ID: LIB3279-234-Q6-K6-E6
gtcgaggggagccaggatgttgaagaacacaaggacgagaaggaagattctcaggctacagaaatctacagtgaccatcaggctcctgttgttgacgctgaacatgtggatgatgaaggcctggtgaacccagctcatgaagttccttcagctgaggcagagcaggagacatttgacgattatgtggacgatcaggaacaaaaagaccaacaattcacccagcggcgctcttaccagaaccagcgtagtggcggcggtcgtggtggcggcaggaggggctatcctaatggtcgtggagtgcgtgggtaccagaatggccgaggtggcggtggataccagaatggccgtggcggaggcggtgggtactacgaatctggatactaccagccgaggaactacaacaacagaggccggggtggtcgcaac

SEQ ID NO: 16817 - DNA, 594 bp, Zea mays
  unsure (1)..(594): unsure at all n locations; Clone ID: LIB3279-234-Q6-K6-E8
gcccattcctccatacttgctcacctcatttctttatttctaactacccaaacatttcggttgttcgctctttgaatgtggcacgcttgcgacatcgacaattcatctaggaaagaggggcatcgggagagtggatacaagatgtaccatggtgatcggttagttgcaccgtcccgtcccgcgttaccacgtgcgttgactttatctgagtttgtgtttggttgcatgcacatgtgaagcgcgggttgtatagacagacgcaaaaaaagttatgttggttgcatccacacgtacgcctaaaacggtcgtacgcggtcgaccaggctcacgcgagattgtacacgtgggtgcggtcatccaatctaacggttagagatctctttggttgctacattctatgaagaacagggctgctcaagactagaaacgtatgtggagcatgttggtggctataatcttcgagtaaggccccaattactctaatgtggatacaaatgcatacctactctgacatagttaaaagctacatcatagagcaatgggaatggatgtatcatcgcctggagaccgacanacagtgaaaattgacatgcc

SEQ ID NO: 16818 - DNA, 369 bp, Zea mays
  Clone ID: LIB3279-234-Q6-K6-E9
cccttcttccctttttggaccctcctcctctcttcaacctcttgcggctgtgccaatccccccctgttctctgattgatccatcgatctggtccctcctcgtccccccttcccctccccttgcttgcttgcttgcttgctcaggtaaaaaaaaaaaaaaaggagcaggaggagctgctgcactgcacaagcagaacccctccccctctctttgttcgcaagattctccctttcttgtcatatgccccgcaaaggttttgtttccactgtcttcgctccggccgagcaaagcacctgctgttcttgccacttccgatctctgtgtgccgccccgccgccttttttacgcccccccccaccccccaccccc

SEQ ID NO: 16819 - DNA, 657 bp, Zea mays
  unsure (1)..(657): unsure at all n locations; Clone ID: LIB3279-234-Q6-K6-F1
ctttcccccaatctgcaggctgcaggcgctgctcctttcgccctccgctagcgagcgaatcgctggctcgaccccgcggcgggaggtatcccgccttcgatctggttcactggccaattcgttgcttcgtggggctttggagtttggagccaatcttgccccttaaagtgtcggtggcagcgttttgtgatcatcatgagctttgtgttccgagggagcaggaccgacatcgaggccggtggcttcccagggttcgctcccgagcgccgcgccatgcgaattcatgcagggagcaggccggtgaatagcaattccttggcttttcttctaactgttcttgttttgttcatggtactgaactcgcaccagatctctcccaatcttctgctttggcttgtcttgggagtcttcctaatggccacgagcctcagaatgtatgccacgtgccagcagcttgctcatgctgcagctgccaacagttttctcggccacactgagctgcgtgtgcatgtaccgccgtccattacccttgctacgagaggccggttacagagccttagacttcaactggctcttcttgatcgtgaatntgacgatttagattatgacactctgagagcatttgatgctgacaatagcccacatgctccatctatg

SEQ ID NO: 16820 - DNA, 665 bp, Zea mays
  unsure (1)..(665): unsure at all n locations; Clone ID: LIB3279-234-Q6-K6-F10
caataccatgtttacatatagtccaactcaaaaggttttagaacctaatattgtagttggcgcaccatcgtctgctaggttacctgaagctggtagtcagttaaattgtgttgttttaccagatggtcaggctaagagtagtactattggaaagggatttgtaaggattttggattcgatctctgctcccccagcttttgcaggagagttcccatctaaccaccgcaaatccttggctcgtatttctggagcgcgccccaacacactccatgtttctgctgaagtgatccatataggaagtttagctgttccttctggcgcagataagtgggcgctgcaaaaggatcaaggcatggagctgctcttctctgcagattttgaacctgatgcccgtatacattgtggctgcaacaccattaccgcggtgctgcgtggtggcttctgccttttcttcgtttcagcaataatgctcttagtgagctacgaggtgggcatgtgcatctatggcaagtagcaacctggtactggtctaagataaatctcacagcatttaggttaatcctatgttttgaggcagactcaactggggtctggggccttctgctagcttttaagtgtgccgcattgcatggcatggacctgtggggtgtntagcactagcagta

SEQ ID NO: 16821 - DNA, 664 bp, Zea mays
  unsure (1)..(664): unsure at all n locations; Clone ID: LIB3279-234-Q6-K6-F11
ccgcgattgctcgtgcgcagtgcctccttcgcttccgccgctggtcgccactgccgcttcttcctctcccttcccctcccgctaccacacgagcagcttcctgccgccgcagcgtacgcatggcctcgtcggacggctctgccgcggccctgcccagcgctaccgtcgatgtgcccggcgccggggcccctgtcctcgtcgtgggcgcgccggggctccccgaggctgacttcaggaacgcggtggagtcgtcgctgttcaagcagtggctgcggaacctgcagtcggagaagggcgtcctcacctacgggaggctgagcctcacgcgggttctcatccagggcgttgacatgttcgggaaacgggtgggctttctcaagttcaaggctgatatcgtggacgaggaaaccaaaaccaaggttccaggaattgtctttgcaagagggcccgcggttgctgtgttgattcttttggagtcgaatggagaaacatatgctgtgcttaccgaacaggttagagttcctattggaaaattcctgttggagctgcctgctgggatgctagatgacngaaaaggtgattttgttggcaccgcagtccgtgagggtgaagaagaaactggtataaagcttgatatagaagacatggttgatcttacggcact

SEQ ID NO: 16822 - DNA, 587 bp, Zea mays
  Clone ID: LIB3279-234-Q6-K6-F12
aagaatctccagagtgacattgatatgagcactttcattgggcagaaggtggagaagcaagaagatgaatttccatgcttcagcagttcaagtgcagacaccttccgtgcagagaaagcagcgaattctgtaagacaaactgttgatcgacacagtacatgctcacagccttctggcagggattcattcaggcacgggttcagtcctggtttcaatttccaggagtcagaaccaaacacgttttgggcagatagctatgtttgcaatggtacttttcaggcgggtcttgagttcagtggtgtggttgcaagaaaagacaatgataagaatgaagtcaagattgaggcatctgagaaaccagatactaagatattgacaggaacatgttggctctctgcagataacaggaatgtgattaatgggactgaaacatgtactgatggctcagaagcgttcaattgttctgaagcacagaaggaaacttcagcagtagtgacacaaattactgcgaactagagctctcttcacgaaacctgaatagaactgttacaagattagaatcacattatacctgctaagagggaaaa

SEQ ID NO: 16823 - DNA, 674 bp, Zea mays
  unsure (1)..(674): unsure at all n locations; Clone ID: LIB3279-234-Q6-K6-F2
gtcgaccagcgtccggctctcgactcatattatctctttattctctccttaccaagtcagaaccccagaagcagcanagtcgacaagtcacccatccagaacattgaaccgaaggcttccaattccaacacataatacttagcttacttggttttccacaacgcaccaggtcccctcctatagctccccagcatgtaacttgtgccaagagcacccaccagtcctccacaccaagcatcaacaaataaacatgcgtaatctttcgagtcgccgcaactatccctctaccttctctgttcagcttcggctacttagaaagccagtggtggcagaggcaagctgttgttgagccccgaccgcatcctccttttcctgagcctttctgcaatgatgaaggcgagctccagggactgggaggcgttcagccttgggtcacagtgggtgtggtagcggtcgctcaggtcatcgaaggtcacagtccgtgatccaccaatgcactcggtcacgttctgcccagtcatttcaaggtggatgcctcctgggtgacttccttcttgatcatgcacatcgaagaatgcgcgcacttcagccagaattgagtcaaatggacgagtcttcaggccacaaggggccttgatggtgtttccatgcataggatcagtaatccatgtgac

SEQ ID NO: 16824 - DNA, 471 bp, Zea mays
  Clone ID: LIB3279-234-Q6-K6-F3
cggcgcgatccccgcaaggagatcctgaaaatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgcttatcatttgtactgtactgtcactgtcctaataagtggtacgtgtgcggggtcgtattgtgtctgcttattcacctagaggataatttctggttttgctgcttatgtaatgcttttgaaacgatgaaggaagctacatgctctacagctgctttgag

SEQ ID NO: 16825 - DNA, 509 bp, Zea mays
  Clone ID: LIB3279-234-Q6-K6-F4
gcccctgctcgtcatcgtgctcttcttccccaagtccagcgcccccatccgcatcaacacggggctcacgctcttcacgctcacgctcgtgctcgtgcccgcaatggacgtcatctacgtcaaggggagggccgggctgtacggagcgttcgatgtgactgtcgccgccacggctctgtgcggggtcgccgacgcgctcgtgcagggaggcgtcatcggcttcgcgggggagctgcccgaacggtacatgcaggccgtcgtcgccggaaccgccgcctcaggagtgcttgtctcggcactgagagtcttcaccaaggcactgtacccacaggacgcgaacgggctaaggcaaagcgcgatcctctacttcgtggccggcatagtcctcatggtcatctgcatcgtgtgctacaacgtggcggacaggctcccggtcgtgatatactacaagaacatgaagaagagggcgcagaaagcggaggtcggcggcggcatgacgggccccgcgt

SEQ ID NO: 16826 - DNA, 222 bp, Zea mays
  Clone ID: LIB3279-234-Q6-K6-F5
ggaccattagcttattgagatgttctgggaggtcttgaagagcttaagttcggacaaccagaaaaagtttctcaagtttgttactggatgttctcgtggccccctccttggatttcagtatctcgaaccaaaattctgcattcagagagctggtgttccagggctggaggagcatgcagaccgcttgcctacatcagctacctgcatgaaccttctgaagct

SEQ ID NO: 16827 - DNA, 650 bp, Zea mays
  Clone ID: LIB3279-234-Q6-K6-F6
gggaccctggaacaagtaaatcccagcttctccagtacatgcataaactgtctcctcgtggtatctatacgagtggtagaggaagttctgctgttggtcttactgcttatgttaccaaagaccctgagactggcgaaactgttctagaaagtggagcacttgttttgagtgacaaaggtgtttgttgcatagatgagtttgataagatgtctgataatgcccgaagcatgttacacgaggtgatggaacagcagacagtatccattgcgaaggctggaataattgcatctttaaacgctaggacatctgtcctggcatgtgccaatcctactgaatcacgttacaatccaaggctctctgtaattgacaacatccacttagcgccaacgctactttcaagattcgacctgatttatcttatcttggacaaggcggatgagcaaactgataggcgcctggcaaagcatattgtttcgttgcattttgagaatccaaatttagaggagctcgaggtcttggacttgcagacactagtttcctacataagctatgcaaggaagtatattcagccacagttatctgatgaagctgcagaagagttaactcgtggctatgtcgagatgagaaaaagagggaatagccctgggagc

SEQ ID NO: 16828 - DNA, 590 bp, Zea mays
  Clone ID: LIB3279-234-Q6-K6-F7
ctccgcctccgcctccctagggttttgctctcggctcgtcggatccagttcgggggatcctccatggcgtcgcgtccgtcgctgaagtcgaagcccaagggcaagggcgggaagaaggccaccgctgacgacgaggacgccaccgcggcggcgaccacggtgaggctcatgaaggagtggaccacgtggacgatgaagaaggcgaaggtggtggcgcactacggcttcatccccctcgtcatcgtcatcggcatgaactccgagcccaagccctccgtcttccagctcctctcccccgtctgatcggatcatgacagggcccggatgaggtcggtccgtagtagtttgtagctggtacttcatttgcttacatatgtccgagatcgagttgaagaaggtggatcatgctttctgggcgaatttgaaggatttggtttaataattttgtagtggcggatgtcttctatacatcggatcaaaaatgtcttggttatgtgatctgcagtgcttatgattgtatgaactatatcccttttcgtcttgctgtactgattttggtgcgcgtcttgtgctgatggtttggatggttt

SEQ ID NO: 16829 - DNA, 365 bp, Zea mays
  Clone ID: LIB3279-234-Q6-K6-F8
cgcgtgggttctgtcacttctgtgacttctgtctgcgtctcgctctccggcgactggtgggccgccgccaccctaagccagttgcggaggtttacattggtctcttcgccggcgacgagcacccaccaggagtcttgacaagtttttccaatggaccaagtaccgaatggaaggcataaggtttcttttgcgaagccaagagtagttgtgctttcagattctgactctgactctgaaggttttgtagaagagctaactcctgttcactcaaagtcaaacgggaaggcttcatctgcgagcctaaaaactggtgggaaggcttcagccctttttaaaggtgaaggcagcaaggaaaagcatacagt

SEQ ID NO: 16830 - DNA, 615 bp, Zea mays
  Clone ID: LIB3279-234-Q6-K6-F9
ggcgatgagattgtcacgacggtggtaactgaggattgatctccttgttaaaaaaaaaaaaacaagctacaacaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgtttaaaagaaccaaagttaactaccccggccttgcaacgaaaaacttttttaaaggggccccaaaaataaaatcaagggcccgggtttaaaaaacgtgggaacggaaaaaacccggggttccccaaattaaatcccttggaaaaaaatccccttttcccaaggggggaaaaaaaaaaaaagccccaaacaaatcccctttcaaaaaattggcccaccctaaagggaaaagggaaccccccttttaagggccaataaagccgggggggggggggggtaaccccaagggaaaccgtaaaatttgcaagccccttagcccccgtcccttacgttttttcccctccttttttcaccaattacgcggtttttcccctaaaagttaaaaaagggggcctctctaaagggttccaattaatggtttaacgggccctttaaccc

SEQ ID NO: 16831 - DNA, 593 bp, Zea mays
  Clone ID: LIB3279-234-Q6-K6-G1
caaatccccctgtcccgctaggattccccccaaaccctcccccaaaaccccagagcggagaagagcgcaagatgttcggcttcgggcaccacggccaccacggccagaacccgccggcgcacggcggcgtgcaccagcccaccttcaagatcttctgcaaggccgacgaggggtactgcctcaccgtccgcgacggcaacgtggtgctggcccccgccaacccgcgcgacgagcaccagcactggtacaaggacatgcgcttcagcacccaggtcaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggc

SEQ ID NO: 16832 - DNA, 643 bp, Zea mays
  unsure (1)..(643): unsure at all n locations; Clone ID: LIB3279-234-Q6-K6-G10
cccacgcgtccggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgntgaagctgctgctcttaagc

SEQ ID NO: 16833 - DNA, 228 bp, Zea mays; identical to SEQ ID NO: 15103
  Clone ID: LIB3279-234-Q6-K6-G2

SEQ ID NO: 16834 - DNA, 598 bp, Zea mays
  Clone ID: LIB3279-234-Q6-K6-G3
cggacgcgtgggcggacgcgtgggcgcacgcggtggggacgggcggcggtggcgtggggaggcggaaggcgggggccgccgctgctgccgcaagccgggagtggatggtggtgccggcgtcgggtccggctcgggtggaggaagccgggaagcacgcggtgatggcgcgtacagggcttcccgcgcgcgatctcagggtactcgacccgttactctcgtacccgtccacgatcctgggccgcgagcgcgccatcgtcgtcaacctggagcgcgtcaaagccctgatcacagccacagaggtgctgcttccaaacaccaaggatcccgcctttgcgcgcttcgtccgcgacctccagacccgtgtcctcgcatcttcgtctgaccaggcagctgagttcactgacatggaaggtgaatcatctaatgttgcttcaccatttcccctaccaagtgcatccaaaggacatgaaatggagatgactaagaagactactgctgttgtgcctgagatgactagtagcagcagtatgcccaatttagctattgcaaaagatggaaacaccaacgttttgcctttcgaatttcgagctcttgaagt

SEQ ID NO: 16835 - DNA, 461 bp, Zea mays
  Clone ID: LIB3279-234-Q6-K6-G4
gtttagataaaaatttgagatgtcggaggaagctgctgaaaaaggttaactttatctctggggctaagcttcaattcgacatccgcccattcttcagtcttaatgtcgttgccgccgagtacaatagtgattccccggtgcatccacaccaaggatttcatcaccaccagccccatcaacgactacaatggtgaagagtttgtcttctactctacaaggaagtaccgtgccaaaaaactcaataatagagtaccacaccaaccaaagtggctaattgttgccactagagagaatgtatagcctattatgtctggcacttagtgaatcgatagctttaagggcaagttatgcactcgagtgactacaatagggaagggaggccttccaaggcaagaaagtgctcgttgtcggtttgtgataacaccttttccaaaataatgttcatgcctacattgtttgtt

SEQ ID NO: 16836 - DNA, 652 bp, Zea mays
  Clone ID: LIB3279-234-Q6-K6-G5
ggcgcactggagaatttgattcagtgtgacaatggaagaaagctcatattattttcgtgacttctgttgctcattctatgtttctgtcatctaaccatcaggaggtctggaggatcacaagtgccttggagaaccacaagtatgaaattgctgactgggaccttggtgccggaatatacgtagacttctacgttttgaagaactcaatgcaagaaagaaatgccatggatgattcgggttcactcgaggagatgagtaaatcatgcagaagtttctttggccgattaaacgagtcgttgttagtctggggaagcaaattacctgttgagtcaagggcatgctactcgaagatggcagaggagctatgtgcgcttctggtggacaccccaagcgagacgctgaacctacccatggggtgtcttctaacgatgctcaacgctccagttccggacgagagcaggtcgtcgtacctgcaggacgcactctccgtcttcaccgaaatcctttgcagcgatccgtagcacaagggtccacggtgttgccgtaatctgggtgaagggaagtgaagcctacaggcaacacgccgaagagtttgtacgtctcatgtttggtacttgtagaaaaattaggaatgtataactatgacctgatg

SEQ ID NO: 16837 - DNA, 323 bp, Zea mays
  Clone ID: LIB3279-234-Q6-K6-G6
cccacgcgtccgggagcattctcaaatctctgtcccttcgatggctaatgttttaaggttagcaggtttggatgcgcttgggtgcgcggcaggtgtcctacgactaaactctactggtggtgagcattaggatcctgtaatgataatagtctttgtcccaagggcacctggaccctcacgtgtgattgtgggaatttgcctttgttggatgcaatgttggaacgtgtactaacagagttgttgtgtttgagaacttgatttaaatgttagcctttgatgctaatgagaacagaaagtgttggtttttgcccaacttcctggcc

SEQ ID NO: 16838 - DNA, 443 bp, Zea mays
  Clone ID: LIB3279-234-Q6-K6-G8
gtacgcgggcgccgtggtggccgccgtgggccgcgtgtgtgaccgcaagggggtgcagcaccccatcatctgcagcgagagcgggcgcgcgctggtgtcccaccactcggtcctggtgttcgaggccttctcggctacggcgccgggacgcctggacgcggccacggcctacctactcgacgagctcacggacgactgccgcgccgactaccgcaacgtcatggccgctgccgtgcgcggcgactacgacacgtgcggtctgtacgccgaccagctgaagcggcggtccgcggagctgttcaaggagggtgtccttggcctggagcacctcgccgcggtggacgccttctgcgagctcgtcacccgcggcatgagcgcgcccgagccgccgcgcacctaccacatcaacctgtccgtgttcacctccctgccggacatgtggg

SEQ ID NO: 16839 - DNA, 651 bp, Zea mays
  unsure (1)..(651): unsure at all n locations; Clone ID: LIB3279-234-Q6-K6-G9
ccgattgatgagaagggtgatataacgacaaaccacttcctccctatccatcgtgaagcccctgctttcgttgagcaggccactgagcagcaaattcttgttactggaatcaaggtcgtggatcttcttgcaccctaccaaagaggtggaaaaattggtctcttcggtggtgcaggagtgggtaaaactgtgctcattatggagctgatcaacaatgttgctaaggcccatggtggtttctctgtgtttgctggtgttggagaacgtacccgtgaagggaatgacctgtacagagaaatgattgaaagtggtgtcattaagctaggtgacaagcagagtgaaagcaagtgtgctcttgtctacgggcagatgaatgagcccccgggtgctcgtgctcgtgttgggttgactggtttgactgttgctgaacatttccgtgatgctgaaggacaagatgtgcttctgtttattgacaacattttccgtttcacccaggcaaattctgaggtgtctgctcttcttggacgtatcccatctgctgtgggataccagccaacccttgccactgatcttggaggactgcaagagcgtattacgacaacaaagaanggttctattacgtctgtccaggctatatatgtgcctgctgat

SEQ ID NO: 16840 - DNA, 547 bp, Zea mays
  unsure (1)..(547): unsure at all n locations; Clone ID: LIB3279-234-Q6-K6-H1
gggtagtatattaaggttttttttaaccccgctctgaaatgattattggacatcattgtttggcagcttagaatgctgcaaaaggaagaaccataaatagcatttccattcctttttgtgattctatcttagtaatccaaacatagttgtgctagcaaaacgaggctttagaaaccttcgttttttcacctatgctgcagcgtcggttcgtttgtaggcttcattacttgtcatcgttcttatcggttcctagaatctctcatcgtcaccgagcttcaagcacagagtcgttttccccgcatctgcttgtatttagctgggggggggggggggggggnnnnnntnctgncagaaccgccttatcttttgttgcaaatggcncaggggtttcgctacgttgcgtctgggccaatggtccggtcttcgtacaaggcaggtgaattctacatcaaggctatgatcgaagcggagcgagccaagggaaccgctgcagactcaagtgcataaccgagatagcaccttccggccccacccaccccttgacttg

SEQ ID NO: 16841 - DNA, 464 bp, Zea mays
  Clone ID: LIB3279-234-Q6-K6-H10
ctccccgtgactacctcgctgtcccctctcagtgtccaagcgacgacaccacgccgccgagatgtggatctcagattccgcctttgtggagccctcatcttcctccccatccgcctctgcctccccgccgccgagcccgccaccagcacgccttctccgccaacgcaaccgccgccgacgccgcaacagccggaaacagggcagtgccagcgccgtcgacggcgtcgccgaccccgaggcggaggacgtgtggcgtggggcgcagtgggaggcggcgtggccggcgaggcgggactcgaaacccggcgtgctcgcgggcggagacgacgcggtgggggcggccaggagcctcacggacgacgacctcgaggagctcaagggatgcgccgacctgggcttcgggttcaactacgacgagatccccgagctccggagcaccctgccggcgctcgagctgtgctact

SEQ ID NO: 16842 - DNA, 637 bp, Zea mays
  Clone ID: LIB3279-234-Q6-K6-H11
ccctcttgtcacagcaccccccacccacacacacccaaggccccaactgcagtgcccatccggcagtcaggtcgatggcggcggaagcagcggcagcggggaaggagaagatgcggacgctagtcagcagcgacttcaagaagttcgatgtggaggagtctgtggcgagggaatcgctgattatcctgaacctgatggcggactgcgacgacagtgacatcccggtcttcaacgtcaacgccaagatcctcgacaaggtcatcgcgtactgcaggaagcacgcctcggcgccgcgcgccgatggcggtgatgcggagccaagtgctgcgagtaacaaggcctcagcggacgatctcaagtcctttgatgctgagttcgtcgatgttgacctggtcaccctcttggagctcattaaggctgcagactacctggagatcaatgggctgctagacctgacctgccaggccgtcgcggacatgatcaaggggaagactccagaggagatacgcgagacattcgacatcgagaatgacttcacacctgaggaagaggctaaagtgaggagggagaatcagtgggcctttgaatgaacaagctgcaggctagctctaacaaaacaatagccatatcatataac

SEQ ID NO: 16843 - DNA, 195 bp, Zea mays
  Clone ID: LIB3279-234-Q6-K6-H2
tgtcctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggtcccaagtttccttccccgggcttgcaacttattattttttttttggggccc

SEQ ID NO: 16844 - DNA, 552 bp, Zea mays
  Clone ID: LIB3279-234-Q6-K6-H3
ctggcttggacctctctggtttatttgaagaatctaacaagaagagagaatccaaattcacatctaccaacacaagctcgacaatcatatcgaagatcgaagatattgcaaagaatttgcggttgaatttgacaaaaaaggatggtggcttgttaaagatggaagcttcaaagcccggaaggaaaggggtaatgggtatcgatgccgaagtatttgaggttagccccaacttccatcttgtggagataaagaagacgaatggcgacactctagagtatcaaaaggtcctgaaccaagaaatgaggcccgcactcaaggaaatagtgtgggcttggcaaggtgagcaatcaaagcaaaagcaggaacaacagtcgtgttaaaaacttatgagctagtgcaatgtttttagccaatttccaatctttcgtgtatttgtgtagtttttactcttttattatccatttttgttttcccgtgtaataccaacaaaaacttgtgtagttgtgttattttctgaggacaaatttgtttcaaagatgtgtttacgctgtt

SEQ ID NO: 16845 - DNA, 654 bp, Zea mays
  Clone ID: LIB3279-234-Q6-K6-H4
acttgatctccttatctgagcaagagcttgtcgactgtgatacttcgtacaatcaggggtgcaatggaggtctgatggactatgcgtttgagttcatcatcaacaatggcggaatcgacaccgagaaggattacccttacaagggcacggacggacggtgtgatgtcaacaggaaaaacgcgaaggttgtcactattgacagctacgaagatataccagcgaacgatgagaagagtctgcagaaggcagttgcaaaccagcctgtcagtgtcgcaattgaggctgctggcacagcatttcagctctacagctcgggtatcttcactggaagctgtggaacagcgctggaccatggtgtcacggccgtcggctacggcacagagaacggcaaggactactggatcgtgaagaactcatggggcagcagctggggcgagtccgggtacgtgaggatggagcgcaacatcaaggcgtccagcggcaagtgcggtatcgcggttgagccgtcatacccgttgaaggagggcgccaacccgccgaaccctggccccagcccgccgtccccgaccccggcgcccgccgtgtgcgacaactactactcgtgccctgacagcaccacctgctgctgtatctacgagtacggtaagtactgct

SEQ ID NO: 16846 - DNA, 249 bp, Zea mays
  unsure (1)..(249): unsure at all n locations; Clone ID: LIB3279-234-Q6-K6-H5
atctgcccttgccgccgccgcccgatccaggtctgtagactgctcactcctctccgctccggtccgaatggcccgcacgaagcagacggcgcgcaagtcgaccggcggcaaggcgccgcggaagcagctggccaccaaggcggcgcgcaagtcggccccggccacggggggcgtgaagaagccgcaccgcttccgncccggcaccgtcgcgctccgcgagatcccgaagtaccagaagagcacggagct

SEQ ID NO: 16847 - DNA, 673 bp, Zea mays
  Clone ID: LIB3279-234-Q6-K6-H6
cggacgcgtgggtccgccgacacctgagtcttgtcgctgccgccgggatggccggagtcaccgccaccgggatggccggagttcccgccaccttttcctcagccaccggttaagatcggggggctttcctttcgaaagaaagccttaccccgcccgccgttggtgggccaacgcaccttttcccccatgcctttgccatacctttctcgcttcggccattttcccaacacccgattcaaaaagtgggaatctggcccaatttggccgggaaggaaccggaagtgtgggatcaagccgagacgatttattaaggcatgcagtttgagtgggaaacaaggtcccggaagctgggagttcttgatggcagatgccgtagcacaaggcgcaaactgcgttattactgttgggggtatacagagtaaccactgccgtgccacagccgtggctgctaagtatctcaatcttgattgctacctgatactacgtacctccaagcttcttgtggataaggaccctggtttggttggcaatcttcttgtcgagagactagttggggcacacgttgatcttgtgtcaaaagaagattatggaaaaattggtagtgtggctttagctgacctgctgaaaaaaaggcttctggaagaagggaggaagccgtatgtgattcctgttg

SEQ ID NO: 16848 - DNA, 382 bp, Zea mays
  Clone ID: LIB3279-234-Q6-K6-H7
tggaaggctgagtctgtgcatgggactccttttgaaattgactgctctgaagatgaattttctgagtatgatgagaagggagaatgcccggttgagctaagcaagctgcagtcaacattcaaagtggtgaagaagcatgagaagggtggtaagacaagatttgtctagatccagtgacttggagtctgtcgggtattggaatcggaggtgtataaatggtacatttgggctaaaaggttgtgcgtaagacgtaccttctctgtctattgattttgtggatgccgtgaaccatgtgaagctttcagtgacagtgtccacagaggcattgccctggaccgattactattgttctgtggtctgaggtcatcggaaccgatctttt

SEQ ID NO: 16849 - DNA, 455 bp, Zea mays
  Clone ID: LIB3279-234-Q6-K6-H8
gatactagcaacaagcccgaaggatttcaaggagttcgctgatgctgttgaaaccatcaaggacaatggggtcgtggttgccgttgcctcgatagatgatgttgaagctgcgaataaggaaaacccggtattccctgaagtaaagaagtgcctgtgaggtccaccaccacttcttgataaggattctagccgggaggtgttttttttaccagtgaatgcggagtctgacaatgtacgtaacatattgcaagagcaccatctctccgaccacggttatagttagccgaatcttggcttctcttctcccatgcgattttaattttggcagtcaataattagttcagatgtagacatagatgcatgctggtagatggctagcgtcttcccatgttggctcaaacgtcggatgtacacaatgattcataaaaaatagaaacggatggtgagatttctac

SEQ ID NO: 16850 - DNA, 402 bp, Zea mays
  Clone ID: LIB3279-234-Q6-K6-H9
cctcctcctacgcgctcgcagcctccgccgccttcccccgcgcccgagctgcgttcgccgtcggcaccgtcttgtcggccaccgtcactccagttcttgacgtctactgcgggagaggggacaagaaaacgaaaaggggcaaaaggttcaaccattcatatggcaatgcgaggccgcgcaacaagaagaagggaactgggcctgcgcggctctttgcccctcctgctcctccaaggaaggatcagttcgatgatggggagatcatttcaatcgagattgacgaggacatcctggaataggttgtccgagttctgccttgctttatatttgccctgagcttaattggcctagtttgtaccaaatcaaatactacatattttaagtaattatttcctcgcctat

SEQ ID NO: 16851 - DNA, 627 bp, Zea mays
  Clone ID: LIB3279-200-Q1-K6-C10
caaatggataagaagccacagagacttacccttgaggtgtaatcaatggtgtaatgttgttagatgggagtttagcaatcctactccattcataaggagccgtgaatttctgtggcaagaggggcatactgcttttgcgaataaagaagaggcagatgaagaggttctccaaatcctggaattgtacagaaggatatatgaagaatttttagcagttccagtgtccaaagggaggaaaagtgagatggaaaaatttgcaggtggactttataccaccagtgttgaggccttcattccaaacactggtcgtggcatccaaggcgcaacttcacactgtcttggtcaaaatttcgccaagatgtttgatatcacttttgagaatgagaagggtgttagggaaatggtttggcaaaactcttgggcctacacaacccgctcgattggagtgatggtgatgacacatggtgatgacaaaggcttagtattaccgccaaaggtggcaccaatccaggtaatcgtgattgcagtgccttataaggacgctgacacaactgccataaagggagcctgcgaatcaactgtttacacactcaatcaatctgggattcgagcggatcaggacacccg

SEQ ID NO: 16852 - DNA, 533 bp, Zea mays
  Clone ID: LIB3279-200-Q1-K6-C11
cccacgcgtacgcaaaaccccaatcgcacaggagaggacgagagagaggggttccatgcatggctcccggggtcgcttccgagctggtcccgcaggagcccgtcctcctcaaggacatgctcgcctgaccgtacacctgcgggaacaccggtgtcttcgtccgccacctattcggcaacggagtctcgccggcacactgcttggacgacggcattaaggacgccgctggcgaccgccaccgtgaccgcgacctgtccatccccaagatcttgaccggacacgtgctggacctgctcaacgatgctgcgaggctggacctgatgctggcactgacgggggacggcagtgccgcgttcatggcccgcttctccgcgcgctggtggtgggtctggaaggaggatggccacgcggtgcagctgaaggtgccgatgccggagctggtgaaggagcacgtgaagatgcacgtggagaaggacaccctggtgatcaaggaggaggccggggaggacctcgagggcgacgacgacaagggc

SEQ ID NO: 16853 - DNA, 634 bp, Zea mays
  Clone ID: LIB3279-200-Q1-K6-C12
ctcgatctgacccctccctccaaatcctgtttgactccctctccaaatcatgctagccgaaacgcccctcctcaaatctgagcatcaaatcgactcctcatcttcctgaaaccatccactcctccctaaatcctctcagatcaaatgccccttctcaaatatggagggctggaggacgagtgaatcgaaagaagaggccgagggggtgattgggatttttcttcttattttgccaaatacaaatcagctacttgctaaacgatatttgctctggttgttgcagttctattgctgcttcatgttttttctcaagcatttctccatacttctctctttttctacttgcgacatgaatatagtttcctcttttttctgtaatactatctattgcaggataatctaaagtaacgacgagcaaatataagatcggtggatctcagaaaaaggaaataattgatgagaaggatcttccacaacaaacaaaaaatcaaaagggtccaatctcaagggaaatgtaaaaaacgatgaatgatataaaccaagaagacaaaaagtagtagactttagaaaagccttttgaccagtatgatatttttataatttctgtttcgtagaacacaaataaagctacatc

SEQ ID NO: 16854 - DNA, 577 bp, Zea mays
  unsure (1)..(577): unsure at all n locations; Clone ID: LIB3279-200-Q1-K6-C3
gcagccggcagttttgcgtttggcgcaggagttcacgagcgggacggccactcctgacctgacccctcccaaatcccaacacctcgtggccttccgccttcgccgcccgtctccgctccgcttccccccgcggggcgggagccgggagtgcgcgctcgcgtccccccaccccctcacctcttcagatctccccggccgctgcctcggttggacctggttgtcgcgcccaggccaagcttggttgtgtccccggcgacggcgatgcggcgaggcgctgcgctgctcctggtggccgtcttcgccgtggtcgccgtagcgaagggtcgtgctgataccccaccagctgaaacaaatagtgatagctctactgcacagccaggccttgggaaattggagcagcatgagcaggcaaatccctataaggagcatgtgacccaccaggaaggaggagtcagncatgatattggtgaccacacccagagggatactcnnacagagtnacccacatcangagagatgggctcatacagcagcccaagcacanagatagcatcatgaccaagtcttcacaccacta

SEQ ID NO: 16855 - DNA, 435 bp, Zea mays
  Clone ID: LIB3279-200-Q1-K6-C4
gagcaaggtacaaagctgcttaccctgatgttgaggtccagccaccatcacctcccaggacaagcacgccaatggatgttgaccaaagtagttcacagaagggtgctgcgctagatggtggcgagaggcccgcctgatgctagcaaacttacttgcgagttatcgtgtcaggacccactactgatcatataggtttcatcgcgttacccctgttgtaaaattaggcagctcagtgtgtgtttggctactgaggattgtttcagtatatcatgtgaaagaaattgcactgtaacagccccagcaaatattgccgccaatgtaatcagggcccatcttgtcttattttcgaaattccaagtgcatctgtatatccaaaaaattgaaaagaaatctgcttctcttttctgggggcaataattttattccttgctgggc

SEQ ID NO: 16856 - DNA, 421 bp, Zea mays
  Clone ID: LIB3279-200-Q1-K6-C5
gggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagcagttgtggtagctggttgctttgtcgtcctgtagtcgtgcttctttgggtctgtaagaaccgctggttcgatgggattggattggacggtgaagtaggaatgttggcatgtt

SEQ ID NO: 16857 - DNA, 392 bp, Zea mays
  Clone ID: LIB3279-200-Q1-K6-C6
cccacgcgtccgcttgtaggatgagaaggctttctttgatgactacaaagaggcccacctcaagctctccgaactggggtaaccattgattgcacaaattgtgcttggtcaattttaacaaatttgatcgtttactcttgtggaatgcaggtttgctgatgcttaaatagaccctatcctggagtgatacattctgctgcatgtggtcttttgcatctggagtcaatgtgaacaagcagattgtcgtattgtctttctcgtaataaatttgtcaatgttgagcccttaggcttgaattgtgggaccctttgttcgttttcctagactctgatgctgtatgcaactgaaacgagtaaatctatgatcttaaggctgcagtatgttcttgtgtt

SEQ ID NO: 16858 - DNA, 635 bp, Zea mays
  Clone ID: LIB3279-200-Q1-K6-C7
cccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctcctcgccgaccccaacctctccttcttccgggattacctccagagtttgggtgccaaaattcccgccgccgccccctctttcgaaagtcccaagagatcttccatggacgacattgatgacgacggtgatgacgacgacgatttggatatgagggatcccactcctgagcgagacgagctcgatgaagagattgttgagtctgatcttgagctcgaaggagaaattgtacagtctgaccatgatgacccaccacagaagatgggaaatccttcagtggaggtgactgaggaaaaccgtgatgcttcccaagaagcaaaaggcaaggctatggaagcaatttctgaaggaaaacttgaagatgctattgaacaccttaccaacgcaatagtgctgaatccactctcagcaatcatgtatggtactagagcatctgtgtttataaaaatgaagaaaccagctgctgccattcgtgatgccaatgctgctctagagatc

SEQ ID NO: 16859 - DNA, 552 bp, Zea mays
  Clone ID: LIB3279-200-Q1-K6-C8
ccgtgctcatcttcgcggcggggacggggatcagtgcgattcgatcacttatcgagttcggtttcgctgccaaagaaagagctgatgtgaggctttattatggtgatacaagtctgaaatctatgtcataccaggaaaggcttagtaactgggagtcaactggaattaaaataataccagtcttatcacaaccagatgacagctggaaaggtgaacgaggatatgttcaggatgctttcttcagaaacaagaacatagtaaatccatcttctacaggagccatactttgtggaccgaatgaaatgcaggaggaactcaccttatcccttgtagcagatggtgtctcacgagacaaaatcttaacgaactactgaaagcgatctccggtctctgatgtattttatgaccagttaggcctcaacgtgtaaactttattgcttaggcctggctgtgatgttccagtgatatatgaataaactactgaacttgagacgaggatgtaatgttcagtgatatattatatgaataaactactgaatttgaggcgaggac

SEQ ID NO: 16860 - DNA, 636 bp, Zea mays
  unsure (1)..(636): unsure at all n locations; Clone ID: LIB3279-200-Q1-K6-C9
cttctcctgacgacgctgttcttcttcttctccaagacattccttcttcttctaccttctacgctatcttccgctaacaggctcccgcccccgcaacgtcgtcttcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttcggctccgtcgacgaccccatgttcgtggaggccaccaggttcaactccgagcgcagccgcctcgcgcagagcttcgactacaactacggcgacttcatccccgtcctgcgcccattcctgcgcggctacctcgccaggtgcaaggacctgcaggccaggcggctcgccttcttaacagcaactacgtcgagaagaggaggaaggtcatggnacgcgccgnggacaaagggcagctcaggtgcgccatcgaccacgtcctncaggcggag

SEQ ID NO: 16861 - DNA, 58 bp, Zea mays
  Clone ID: LIB3279-200-Q1-K6-D1
ctctctaatcggtacgactcattggcatcgcctccgacgatcttgagacaaacaaaac

SEQ ID NO: 16862 - DNA, 623 bp, Zea mays
  Clone ID: LIB3279-200-Q1-K6-D11
ggtcacgtgactcatccccctgtgctctcctctcgtggccttgtttcctggcggcgacggctggtcgagcggcgccgcccttggctaggtcttcgctgggtccttccccggcgacgagcgtccatctggggtcgactgaactgagcaggcagtaggaagagacactatgttgttcttctcctacttcaaggagctggtggggaaggaggtgacagtggagctcaagaatgacttggcgatccgcgggacgctccactcggttgaccagtacctcaacatcaagctcgagaacacccgcgtagtcgaccaggacaagtatccccacatgctttcagtgcggaactgcttcatcaggggctcggtggtgcggtacgtgctgctcccgcaggacggcgtggacatcgacatcctccacgacgccaccaggagggaggcgcgcggaggctgatcctgatgcgcacccgctccctcacctgctggctgctgcttcatccccgattgtacgaagcatgcatgtacggtgtgtggtagacagatgccccagtttagttctttggtgcttgccttgacatagatattccaggttggatgatgacctgaatcacctgatatattattgtcat

SEQ ID NO: 16863 - DNA, 628 bp, Zea mays
  Clone ID: LIB3279-200-Q1-K6-D12
gggagctcgcaatcgccgctgtaaccttgttgcagcgtgcttgggtcgggaagcagaggagagtaacctacgggctcggcgaagccgtccgcggccgaccaacggcttggggtctccaacagctattgaatcgtcaccgggcttgcgacggactgctcggcgacatcgccagctcagtcctcgtcacaaacgcggaccagtaaggcgacctgaggggggtgaatgggagccaatcggatttttgtctccaaacattgaaaattaacactttacttcaattgagatgaagtaagcgctcaaaccataaacatatcagcgaacgagtgatctcatgattacaaaacgttcctaatactcacatgagaccagcaaaacaaacggatcgcaaatcggacaccaaaaagtccaaaacggtccaatacagtatcgtcaccaagtgcagttttcagcagtacgaaattctgttcttgagttcaaaactgaactaaacgaactcctattgatatgaaattttacacacacctgagcaaatacctttgctagatctccccaaattttaagctcaatccgacttgtgaatcacctgtagatttaaaaatacagcagcaattggggttttgttggggtt

SEQ ID NO: 16864 - DNA, 626 bp, Zea mays
  unsure (1)..(626): unsure at all n locations; Clone ID: LIB3279-200-Q1-K6-D2
gaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaacatcattcccagcagcactggagctgctaaggctgttggcaaagtgctttctgtccttaacngnaagttgactggaatgtctttccgtgtcccaccgtcgatgtttct

SEQ ID NO: 16865 - DNA, 646 bp, Zea mays
  Clone ID: LIB3279-200-Q1-K6-D4
ggggcctcatctgcgccagatgctatcttatggttgtacccgcttggaaattggtgtccagagtacatatgaggatgttgcccgtgacacaaacagaggacacacagtggctgctgttgctgattgcttctgtttggcaaaagatgctgggtttaaggtggttgcccacatgatgccagatttacctaatgttggagttgaaagagatttggaaagtttcagagaattttttggaagtccagcgttccgggctgatggtctgaagatttatccaacacttgtgattcgtggaactggtctttatgagctctggaaaactggcagatatagaaattatccacctgagctgttggtggatattgtggcaagaattctgtctttggtaccaccttggacacgagtgtatcgggtccagagagatattcctatgcctcttgttacttctggtgtcgagaaaggtaaccttcgcgagcttgctttggctcgaatggaagatctgggcttaaaatgccgggacgtcagaacccgtgaggcagggattcaggatatccatcacaagatccggccagatgaagtagagcttgtcagacgtgactatgctgcaatgagggttgggaaacattcctctcttatgaggatacacgac

SEQ ID NO: 16866 - DNA, 511 bp, Zea mays
  Clone ID: LIB3279-200-Q1-K6-D5
cccaggcttccggcaaggcttaccaatgaagcatggagttctgacttctggtcgggttcgtcttctgcttcataggggcactccctgcttccggggttatggcaagcgtaatggggagcgcaggaggaagtctgtccgtagctgcatcctgagccaagacctatctgttatcaactagaagattgagaataatggtgataatgatctgtctgctctgactgacactgagaagccaacgatgaggggttccaagagggcctacaagatcagaaagctgatcaaccttaacaaggatgatgatgtacgcacgtacctgaacacataccgtacgacattcactaccaagaacagcaagaaggttaacatggcacctaatatccaacggcttgtgacacccttgaccctccataggaagcgtgctagaatcgctgacatgaataagaggataactaagaataagtctgacgctgatgattaccacaagcttcttgaccagaagctgaacgaacag

SEQ ID NO: 16867 - DNA, 580 bp, Zea mays
  Clone ID: LIB3279-200-Q1-K6-D6
atgagcttatattcctatatgactactagctagaaattaagagcgctaatactatattaattgtgtaccatattcatcatttgctcgttcgaggagaaatttaaagtcttactagtgtcactactgatattttatttattctaaaatattaagaataatagtaaaagtgtgtcttgtagaacacattataatatctatttttagatgcgtgttattagagtggtctaccgtgtgttgttattgccgttaaatcctgaccatattgaatcctaaagctaaaaaggtcgaacatcagcgatggagtggaagagcaacgacatcccctccggcgttgttagccccgtgacgtcggaaggtgcaagggagtcttcgacgtcgagcaagaagatgagcagcgaggagcaacaacaagagagcgaaggccgtcatcgcacggaaggcatgccaacgttcgtttgaatgggctcaagtgggccgtgtaatacttaagtgggccgctgggtcccgatgctgatataggtcagtctgtgagaacattaaggccatcgaataacaaaatagcaaatccatttttgccgct

SEQ ID NO: 16868 - DNA, 629 bp, Zea mays
  unsure (1)..(629): unsure at all n locations; Clone ID: LIB3279-200-Q1-K6-D7
gtacgcgcacgagccgctgtacttgcaatggaaggactggaactgcaagagcgaatgcagataccactgtatgatggaaagggagggtgaaagagcaaagcttggccttcagcctgttaagtatcatggcaaatggcctttgaaacgcgcctctgtgtttcaggagcctttatctgcagctctctccgctcttactctcgttgtgcaatttaatgggtggctttcgttcttcctcttgctttattataagcttcctctacggccagaaactcacaagacatactacgaatacactggcctgtggcacatctatgggctccttgccatgaattcatggttctggagtgccatatatcacagttgtgacacaatttggacagaaaagctatatttttcatcagctgctgcctttctggggtactctctcattttggcgatactgcggacttcaagtttaagagacgaagcttctagagtcatggttgccgctcctattctggcatttgtgacaacccacattctgtacctcaacttctatgagcttgacaaggcctaaacatgaaggtttgtactgtgataagcattgctcagtgtctnctgtgggcactgtgggctgtcatgagtgggca

SEQ ID NO: 16869 - DNA, 565 bp, Zea mays
  Clone ID: LIB3279-200-Q1-K6-D8
cattaaatcaaagggtatgcggcctggtgtatcattgaggccaggtactccagtggaggaagtttttcccctggtggaagcagaaaatccggtagaattggttcttgtgatgacagtcgagcctggttttggtggtcagaaatttatgccagaaatgatggataaggtgcgcacactgagaaagaagtacccttcccttgacatagaggttgatggtggtctaggtccttcaaccatagacgtggccgcatctgctggggccaattgcatcgtcgctggaagctctatatttggcgctgcggacccaggagccatcatatctgtgctgaggaagagcgtcgagggctctcagaacaaaaactgattttggtgtttctgctgtaaagtactccctccgtttttttattcgtcgcgttttagttcaaacatgaactagcggacgactgatattcgagaatggagggattacttcgaccctgcacgtcagatgagctgatcctcacattgcaccggaactgttcggcgagaataaaatttgatgttagaccttgaacgtcttttgcat

SEQ ID NO: 16870 - DNA, 565 bp, Zea mays
  Clone ID: LIB3279-200-Q1-K6-D9
ctgagggctgttcccttctgcacaatcagcttctcagtattcctattggtacatggtctccacatacggggaggtcaagtagcaggcaactcagaactttgctactgagttctcctctaaatacctgcctggatattctgcttcaagatagagtaagctcaattcctatagttgatgacaatggatccctccgtgatgtctactcactcagtgatatcatggctctggcgaagaatgatgtttatgctcgcatcgaacttgaacaagtgaccgtacaaaatgctttggatgtgcaataccaggtgcatggccgaagacagtgtcatacttgtttacagacgagtaccttgctggaagttttggagggattgtccattccaggagtgcgacggcttgttgttattgaacaaagtaccagatttgtggaaggaatcatctcattgagagacgtatttacatttctccttggatagcatgtgtagccattccatacatgaaaaagcttgctgtacttggttcaaacgaaataaaaagcttacaaatgtgatagtcatcttcttgtttc

SEQ ID NO: 16871 - DNA, 629 bp, Zea mays
  Clone ID: LIB3279-200-Q1-K6-E1
cgctcatcacttcgctccaagccagtgctagcccggccccttgtgtacgtgagagacggcatcgtaccgtagagcagcacatccatggctcagggaagtggcagtgctcgtggcagcggcgccgccgccgcgcttgcgctggtcctcctctgcgtgctcctccacggcgagctggccgagtcggcggtgtacacggtcggcgaccgcggcgggtggagcttcaacagcgccaactggcccaagggcaagcggttccgcgccggcgacgtgctcgcgttcaggtacaacgccaaggcgcacaacgtggtgcccgtgagcgcggcggggtacaggtcgtgcagcgcgcccaagggcgtgagggcgctcaccaccgggaacgaccgcgtcacgctgaagcgcggcgccaactacttcatctgcagcttcccaggccactgccaggccggcatgaagatcgctgtcaccgccgcgtgaggcccccggccgatcagccgcgccggcgacgacgaccgccggacacacgggctcgatcggtggccagcttattattatttttattttcctctgcaaagtaaaagcgtcgcgtgcttaacctgcgtgttggtaggcggtgttaggtgtgtggagac

SEQ ID NO: 16872 - DNA, 380 bp, Zea mays
  Clone ID: LIB3279-200-Q1-K6-E10
tgtagcgatgcgacaatctattgtacaatcaatcaaggtgaggctgtatgttagcacccataattcatgatgtcaggattaataattagaatacaaccacaacattcaatattatgagaggagatcatctactgtatcctaaccatctagacttagagatcatcttgaacgtctgttttgaagaggatgcacatttgtttagaaatagtttcgttgcttttgtggcgagagctatgtgttctgtctgtgttgtatgattttaaaagagttgtagattgtactatactagggcgatcgccgtcatgatactgctattagacgtaatgtaatattgagaattgtattatatataatatttaaaacaaaagattgagaggaat

SEQ ID NO: 16873 - DNA, 552 bp, Zea mays
  unsure (1)..(552): unsure at all n locations; Clone ID: LIB3279-200-Q1-K6-E11
cggacgcgtgggtggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcatccagggtttatgtatcgaaccagtttatgggatcttgctcctattccaatgcatnccatggtttgtgaat

SEQ ID NO: 16874 - DNA, 639 bp, Zea mays
  unsure (1)..(639): unsure at all n locations; Clone ID: LIB3279-200-Q1-K6-E3
gttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacngcggtggcggcggctaccgtggtggcggcggcggctaccgtgggtggtggcggcggctacngcggtggcaaccgtggcggcggctacggcaactccgacgggaactggaggaactgagcggtggngcccgcgcggncaagttatcctgttcgctaccgtgttgtttaccctagtccagagtgtttatcttcgttcgtctc

SEQ ID NO: 16875 - DNA, 639 bp, Zea mays
  Clone ID: LIB3279-200-Q1-K6-E4
ctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcgag

SEQ ID NO: 16876 - DNA, 648 bp, Zea mays
  Clone ID: LIB3279-200-Q1-K6-E5
gcaaaatatttccggtcctcaaagctgccgcccgccctccttccctccctccctccggcgccagttcaggcacaggcaggcttcagtctccagagatggcgaggaacgagcccctagacttcgagaacgaggacgatccggtcctccccgccctgcgccccgccaagaggagcaaggtcatgggcatggatgatctcctgctggattactttcaatctggtaaaaaggacaagctcaaagttaaggctgccaagtctaagcatggccccaaaggaggatatgattcaggtgaggaagacgacagggctacacagcaagagattacagtctgcaaaatatttgaggaagttcagcaaaagggcaaagtgatggatgctagagacgatgtacccccatggggtcaacaattttttagatgccagaaccccccctcaaatcttagcaatggacggagttgagaattgtcatctcctgcaatcattctctgcaattgaagatataggttttgatctagagatgcatcaaggagaggggttcctcgaaggcatgctgttggatggatggcttctgaatttggttcgcatatgtggttttgttgaagactctgtagcatagtggacgctgaccaacttgttgcattcacccaat

SEQ ID NO: 16877 - DNA, 642 bp, Zea mays
  Clone ID: LIB3279-200-Q1-K6-E6
agcaattccctccccccgctccggcccctcgcaccgtttccctttccccgccgctcctccgaagccaccaccgtgccccgccccgcgagggcacgaaagaggaggaacgcggccaccgccggcgagggttcgggctccgctcccgacggtttgcaacccgggagggagccgaccgtgcgcgcgcattgggcccgcgcgggggaagcggcaggcgcgtgccgtttttatttagcccgctccgctccgcgcccggcggctgcggggtgtggtgctcctgctgattttcttctcggcgccatggaggccggctactgcaaccgcaagaagaccgacggcatctgcgacggcgtctgcgacagcgaggtgaggccgcctggcggtggtgcctgtatcttccccttccacgcacgctgcttaaacgcgttttttttcgctccacgcggagccgcttgcttgcttgcggctttgcctgcctcgaccttctgatcgctccaattgtctcgtcctgctattttgcgaatcgcggcaaggttcatgttgtactccgcgagatttcctcggcctcgcactgcgtatgctcgctcaatcgctccagcggtaggcatctctcatctgccgcgggtagctggggattatagggcg

SEQ ID NO: 16878 - DNA, 519 bp, Zea mays
  Clone ID: LIB3279-200-Q1-K6-E8
ctagtacaaagatctacttactcaatggcccctgttatgcctacaccaatgaagagtacctggagccctgctgatccttccgtggatccacttttttggagcaactttgttttgccatcgagtcaacctgttacaatggcgacaataacaacaacaacgtttgcaaagaatgaggtaagttcaagtgatccattccagagccaagagtgactgcacgagcttactgaagcaggatattttagattggtcaaagacagcatcccgtgcgtcaactagattctttttgtcaagcttttgatgtcgcaacttgtgagcaatactccttgtttatccatacttcataggacatgaatagaaggtatgacaagtgcaagcatagttatgtaatatacagtggctagttgccagaaaatgagatttagttgtgtagagctgtttgtacatattgagatggttgtttcagttcaatctcaacaggtttgaggaaaatatccaacgaaatgatacagttttaatgct

SEQ ID NO: 16879 - DNA, 584 bp, Zea mays
  unsure (1)..(584): unsure at all n locations; Clone ID: LIB3279-200-Q1-K6-E9
gaggataaagaaaaacgatttgagaagttgctgcaggaggagcgctcaaaggctagacgctttgatgttgattctggaactaccgaagaagatcgtaagctaaggaaggaacatgtacagaagttcattgattgccaggtcaagaatgtggcagagtttgaagctgagcgggatgagctgatcaaaggccacgaggagaagaagatgaagctcaagaaacaatacatgaagaaggagctggagctggagagggatcacgacgcagccctgacggccctgatggagaagcataagccagatacttttgaggcctccagctcgtgaataggcttcagcgagatattcaatagatgttgctaaaacatggtgtctgttgtggtagtgtgcgtgatatggagacatgacatgaccaacaccgcgttatatgatcgtactgtgtggttcgagcatctgaacactgagcgtattgcctgtgaggctgtgatggcatatgggtcaaaccacagcttcgattntgccctctaagccatctctatagactgctgtctatagagtaaagagtttgtaacatgaagtgagatagg

SEQ ID NO: 16880 - DNA, 628 bp, Zea mays
  Clone ID: LIB3279-200-Q1-K6-F10
ttcgtcttctccccacagcagcccggggaaaaccctattatagcaaaccaccggagcagcggcgcttgcgcgggcggagccatggcggacgacgattacaacgaaattgacatggggtatgaggatgagcccccagaaccggagattgaggaaggagctgaagaagagcctgagaacaacgaagatgcccctgatgacgtaataggtggtgagggtgaagataaggaacaggaaaagaccaagcgtgaacgcaaaacaacaaaatacatgacgaagtacgaacgtgcgcgcatactgcgtacacgagccttgcagataagcatgaatgctccagtcatggttgagcttgagggtgaaactgaccctcttgagattgcaatgaaggagctgagagcgcgcaagataccctttacgatcagacggtacttacctgatggaagctatgaatactgtggagtagacgagctcattgtggaggactcctggaaacgccaggttggtggagactgaagacgcggatctacttggcatggaaagggtatgtggtgcactgggtctatcctgtagttacaagtcttcgatgccactatgagtggatactgtagcgaatgaaccaagacgaaatgat

SEQ ID NO: 16881 - DNA, 632 bp, Zea mays
  unsure (1)..(632): unsure at all n locations; Clone ID: LIB3279-200-Q1-K6-F11
tccttttcttccccggcttcgtttcgtgctttcctcaacctcccctcttccgtgccgcgcagtttatccgctgcttcacggaaatccttacggggctgcatatattatattccctgcgttccaggcggccccggctcttgctgtctcctcccacaccccgccagcctcccggcgtcccaatcccaggaacttccgtcgcgtcaggaaaagggcgcatggcacactgaagggctattagggacatgagagttgagacatgcttccttcgctgaaccttacttgatagcatctgatgcgcgcaggtgatgctttcagcaactacaggtgtagaacaatgtcgatgaactatgatggggataggagtgaggaccgccagagcgaggaggtccagtcagcatacaaaagggacagtgacattggtgaggaaatggtaataagtagcgaagagcaaaatgatgagaatgaatggagctgggtgaaccaagatagaaatggtgatccttttgctgaatcggtttcctcacttcatacgacacagcanatccttgaaaatgagatacgaaaattatcagaacttggncaagaacttgaggcggaggaatccactttccgtaacaaagaccaagatgtga

SEQ ID NO: 16882 - DNA, 626 bp, Zea mays
  Clone ID: LIB3279-200-Q1-K6-F12
gaaatagatggcacgacaagggcagcaagatggcgcctgcctgttcttgcaatgaccgccgatgtcatccaggccacccatgaagagtgcacgaagtgcggtatggatgggtacgtcacaaagcccttcgaggagaagcagctcttccaggcgttgcagaagttcttggaccccggcatgtcctgctaacgccgaagtgatgcgttggagcgcgggctgctcgttgatcatgccagcggggaacagcaggcagacaaggcagcacgcaccacgggccttcgctggtctgcctgcctgtgcaggcgtcgtgtaaatgtattgtatttgcagggatcctgtttacagcgctagtatggcccgtgccacaatgtcggagctacctgtggctgatgcacgttgcgcataggtggttttttttgtacagctccaccatttttgtgctccagatcagaccaccgaaggaggcaagcatgctcgctggtgcagtgcagcactggaaggaaaacctgacttcctgagagtagatttttgctgtttaattgcattgggatttatgatgtattataatcagataaatgtgtgatgtaagctggcgtaattggcccaatgcatttccattgttatgg

SEQ ID NO: 16883 - DNA, 427 bp, Zea mays
  Clone ID: LIB3279-200-Q1-K6-F2
cggacgcgtgggaccggcaccgcgccacggccgcgttcgtctcgacaggagccgatggccactctcgcgccacggccacatctcctcctcggcttgacaaggccgcagcccatagcgcttcgtgcctgcgccgccttctcccgctcccgccacgcgccagtcccaccgcgggccgcgcagccgcggcgcgtcttcctcggccttggcgctgccttcatcgaccaggccacccgcatggcctccggcggcacctcgtcccgctctttcgttgccggagcgcggccgaggcaaggcgtttccccagtcgagcagattctcaagaatgtcgagtggccagatgagttccctttcaagcctgagggactcagccgcttcgacgaatcatcagatactctgttctactcggttccacgttttgtcactcaca

SEQ ID NO: 16884 - DNA, 520 bp, Zea mays
  unsure (1)..(520): unsure at all n locations; Clone ID: LIB3279-200-Q1-K6-F3
cccacgcgtccggtcgagtcggtagtgggcgaggtattcaacatcgtcaggcagtggcaaactcagcagcagaagcaggtccaggagttccaggcactacacgacacacacttggctccagatgagcattcatagtatttcgtcttccatgtcaattaaccaataaactctttaataattgacgtctcgatgatgtgttatcatccatgtttaacttaaatgtgttctagttctgaaataccaaagtttataaaacaaaagatatgcaacaaggaatcaacattgaactgtaggtgtatgtgtgatagcctaccaagtgtaaaagtagatatgttcccttggttaggtgtagctaaacatatggtgaaaattggcagaagggaaatggtcctaacattcattttttggaagaactatatggtatagactacagagttcagatgctcaaggtagacagtggctgtttggtttggaggtataacataaataaaatgttccatgttattatcgntnnnaaaaa

SEQ ID NO: 16885 - DNA, 160 bp, Zea mays
  unsure (1)..(160): unsure at all n locations; Clone ID: LIB3279-200-Q1-K6-F4
cgaacactgaaaaaggttcctcaatgggggtggattctgacttcacttctgaatgtaaaaccaaaactgtcaataatatgaaccattctgggattactttaaaaagaaagagcagcgatcctnctgtcagtaacaagaaacagggatctgcagttgagcc

SEQ ID NO: 16886 - DNA, 520 bp, Zea mays
  unsure (1)..(520): unsure at all n locations; Clone ID: LIB3279-200-Q1-K6-F6
atcccctttcttcttctggttgctactggctgcagtcttaatcttgcagatgttcattacgaagagggtcttgaggacattcaagcacacgagattcctagttaggtgaaattcctttgtagggggatagtagctaggctctgacaagtagtgcttggtgcgtaatttctgcctttgctctttttccctttgtcagcgtcgaattttggtggtcggttgtaaagcttgtgttgagggggcttttgcggcttgatttttgtcctggattcgagttttgacaccggaggttgaagaagcggtaggatgatggtagtcctttagatcctgttgtaatgtatttaactgtgaggtgaggctggacacaataaattctgtaggcgtgtttagaggaagaagggggaagttgtgtgtgatggtttcttcagagaagattcctgctactgtgtacttcgaatctgtttttggatggagttaaattgacattatcgatgtcgtcccananaaaaaaaanaaannaaaa

SEQ ID NO: 16887 - DNA, 619 bp, Zea mays
  Clone ID: LIB3279-200-Q1-K6-F7
agcgcagtggcaatttttctagcaatccttgggttgacggtgcttcctgttaatgctgttgttggaacatacatcagcaatatgtttgaggacaggcaactgctcatggtctcgcaaattacgttgctagtaggcattatcttcagcttcaaggttacgagtacatactctgttgtccagtatgttgtctcagcacttgtcacatttgtttctgcagaagttcttgaaggtgtgaacctttccctcctatcaagcgtgatgtcatctcgcctctcccgtggcacatacaacggtggcctcctctcgacggaggccgggaccctggcgagggtggtcgctgactgcaccatcactgcggcggggtacctgggcgtggggaagcttctcaacgtcaccctgctaccatccctggtgatatgtgttgcgtccattgcctgcaccttcctgacatataactcgcttttctgatggagcttcacaatgtatttgtgtcatcatgattcgttccatattagcgcaaatcaaggcagctgggagaccgccattgccattgcccgaaggggctattgtattactattattatatgttcgtcgatttgattgctataaattgattgat

SEQ ID NO: 16888 - DNA, 592 bp, Zea mays
  Clone ID: LIB3279-200-Q1-K6-F8
cccacgcgtccgcccacgcgtccggaccaggccgaaggaaaacaatcctgaaaccaagccatgggtcagcaggaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctgtttatgtaacttttttttttttttcgaaagagcgcaggaggactgcgcacccatatattaaagtagagggaaaataaagggccataatgatgatatccatctatctatctatgtaactggtttatgtaccatgtacctgtttatgtaactgg

SEQ ID NO: 16889 - DNA, 459 bp, Zea mays
  unsure (1)..(459): unsure at all n locations; Clone ID: LIB3279-200-Q1-K6-G1
ggcaaagcgtagttctgtacctcctctatcgttgtcctaccactctaggtctatcccttgatctaggtttctatggtctgaagatttgtgattttctccgcactgttgttgctatccccgtgtcgtaataatacgagatgttttaagcggttgaacattacggtggtgtaatcagagtaatctgttgctgttaaggtgcattgttgtatgaattgtctctacccgagtagaagaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaattataaaaaaaaaaaaaaaaaaaaaaaaaaaaaaaaaanagggggccccttttttagaaaacaaaattttcacccaccggaccgaaatttaaaacctttttttttgggaaacc

SEQ ID NO: 16890 - DNA, 629 bp, Zea mays
  unsure (1)..(629): unsure at all n locations; Clone ID: LIB3279-200-Q1-K6-G10
cgtggcctcactcccccgcgcgttagggttgcgatctcatacttcgtgcgctgctcaccaggcgccacttccagctaggccgtcgtcgccgtgccccaccagcttcgtaactacactacctgtcatacagtatccctgttcgtcgtctacactccagttcgattaagccaggaagccgatggagatcatcatctgccaaccattgatgttaaggctgcacatttagtaaagcagatagcaagtgatgaaagtgtagagtgatctgtggacattattattagggttcctttaatattaccatatcgaaagggcgtcaagtgcgatctctgcattcttcatgtattctgtgaggagcaccagtatggtgttgtaccacaattccaagctgaaagaaaaagactacgatgcggatggataccatagcacacccacagaccacagtggcttgctttgcttaccagagcatgacaccagaagagagcgagagcctgacgatggcgccgaggtcgacgaaagcggcggacgagaatgcggtccaggtgagagggcatccgcacgagaagacgaatgcgagctaggccgaacacggcgatccacatggtgaccancatggatcccatgaccccggc

SEQ ID NO: 16891 - DNA, 606 bp, Zea mays
  Clone ID: LIB3279-200-Q1-K6-G11
ctcacgcgttcgctcatcttttctcgtttagaacctctaatatttaccccactcgccagtcgcagccatacctgtcgccatggacgccagcggagccaataacgaggcgaacaagggcgcggccggccgcaaggcaagcagccccaggaagaagtccgtgacgcgctccctcaaggcccggctgcagctcctcgtccgccggatcaggaactacctgaacaaggaccggttcgcccatggcgtgggcacttacctccccgtctacctggactacctcctggactaccttgtcgactaggttctggacttggcaagggacaccgcgaaagacaacatgatgacgcgcatcatgctgctccacatgctcctcgacatccacatcgacaaggagctcgggaagctgatgataggcctcaccatcgtgcacggcaacatcctctccaacatccactccatgctcctgcccaagaaggcggccaacaacgcgggcaacgcccgcaacaacgagcccaagtgcgccaagaacggcaccaagtcctccaagaaggcttactaagtagggacttcatctgcactgtgcgctggagcatgctcgtgtctagatct

SEQ ID NO: 16892 - DNA, 473 bp, Zea mays
  Clone ID: LIB3279-200-Q1-K6-G12
gcatgtcaaactgaactgcccgaaccttgtgttctctggtctgatgacaattgggatgcttgattactcctcaacccctgagaatttcaaggcgctggctaactgccgggaagaggtgtgcaaggagcttggaatacccgaagagcagtgcgaattgtctatgggcatgtcggctgattttgaacaagcgattgaaatgggaagcacaaatgtaagagttgggtcaaccatatttggtgcaagagaatacccaaagaagaactagggtgtttaactatatttggtgcccaaagaactagggtgcttatgcattcctgtcatgatggtagtggcacagaatctgcaacagatccaaatctgatgatgcatcatatatgtgcagttgtgtgcccattctactcagcttaaaacattttgacacccttttttggcccaaagtatcaataaggaaagttaataaaaagcattagacc

SEQ ID NO: 16893 - DNA, 641 bp, Zea mays
  Clone ID: LIB3279-200-Q1-K6-G2
cttggggttaaatctgacgccccttgggatgttatttgggacatcatgcgctgctgggtgaagaaccatcctatcaaggaacaggcacgtgactcacctggcacggtgatcctttcaaaatcgccaaagctagaagcagacttttccagagcagttgctgccctcggcaaatctggggcaaagaagacgaaacgattccttccaaacccagagcggcactggggcccgaaggtcagagcaggccggaagatcacgagcaaacacgtctctctgttgggccctgatgccatcaacgctgccgtgaacggcggcggcggcggtgactgccacagagaagggagcggtgccgcgccagatagtagcaatacagccccagaacccgaggagctggaggacgaaccctcgaacaaacgccagaaagccagcggcgacggggaaccagaaggacagaaggccagcgacggggaaccggcaagcgaagcttgatctgtttggtagtcgttgttgtgcatgtcagcctgtgcttttgctcgtttttggaaatggaaacatcgttccgaccttttgcatttacatgcatacagccttacaactcaattattacatcatcctgcagcaaaaaaaaaaaaaagggcggccgc

SEQ ID NO: 16894 - DNA, 650 bp, Zea mays
  Clone ID: LIB3279-200-Q1-K6-G3
cccacgcgtccgagcagtttaatactgatcaaatgcacttcaatgtgtatcattcaaatatgtatcgtacacactgtcgccagtattctagaaccatcttgagtagtggtttcttattgatccaaaaatataaccccttatcacgctaccgccatccccaccactgccgtctgacccaccggttaccctagccaaacccctccaacgtgcatcccctaccttatgtcagcatcacatatgtaggattcaatttctgtgttcttcctatggcgccgcatgagttagctaccctcttgcaaaatatataaattagattagattaatttttttcactttcgtcatgataaccagatcgagatccatctaattcgttgcaatatcttatcatcaaactaaaaatgatcatggccagtgatgaggtgtgaacttgcatgcatttgtcacaacatgtggcggagtaagagcaagacattacttttcaactccatcaccactcctaccacggtataagtgaggacaaaaataaggcatcgaagaacctatacaacgataaagttgacatgacgaccgccgaggaggagatcaacgagtagacactattcatttgagtcggacaatgaagtagcatcgtgtcatcaccatacaaggcg

SEQ ID NO: 16895 - DNA, 632 bp, Zea mays
  Clone ID: LIB3279-200-Q1-K6-G6
gcgccggcgtgctcgtgatctcaacccaaggcgtgcctccgctccggtcacccgtcactccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattaagcttcgcgccaccggaggcaacaagaccaagacccctggacctggtgcccagtctgccctcagggcgcttgctcgttccggaatgaaaatcggacgcattgaggacgttaccccggtccccactgacagcactcgcagaaagggcggtaggaggggaaggaggctgtaggctctgcgtgccatttgccggctcttggcgggtggccattatgaagttagccctctctgggtggtgttgctgttttctgtgtttgtcagacgagctttattttgctctat

SEQ ID NO: 16896 - DNA, 497 bp, Zea mays
  unsure (1)..(497): unsure at all n locations; Clone ID: LIB3279-200-Q1-K6-G7
gtttctcgcgagccatcgcttcggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagtacggattaccttgtgcctnanaaaaaaaaaaaaaaaaaaaaaaaaaaaaaaaaaaaaaaaaaaaaanataaaaaaataaaaaaaaaaaaannaaaaaaaattaaaaaaaaaaaaatatg

SEQ ID NO: 16897 - DNA, 637 bp, Zea mays
  Clone ID: LIB3279-200-Q1-K6-G8
cccacgcgtccgctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttggtgatgaaactgaggaggacaagaaggcagctgatgagcgtgccgccgctgccaaggcctcttctaaaaagaaagaaagtggtaaatcctccgtccttatggatgtcaaaccatgggacgatgagactgatatgaagaagctggaggaggctgtccgcagtgtccagatggagggtctgacttggggagcatcaaagcttgtgcctgttggatacggcatcaagaagatgactatcatgttgacaattgtcgacgatcttgtgtccatcgacactct

SEQ ID NO: 16898 - DNA, 583 bp, Zea mays
  Clone ID: LIB3279-200-Q1-K6-G9
cccacgcgtccgcacaaacctaacgcggagcggcgcgggccggccgccgggcgaggtgcgcgtacctgccgtcgatcgtcgccggatccatccaccatgggcggtggcaacggccagaagtccaagatggcccgcgagcgcaacttggagaagaacaagggggccaaggggagccagctcgagaccaacaagaaggccatgagcatccagtgcaaagtgtgcatgcaaacattcatgtgtaccacgactgaagtgaagtgcagggagcacgccgaggccaagcatcccaagacagacgtgtaccagtgcttcccccatctgaagaagtgaaaggcctgaacttagcaaccagtgctggtttggccagggggcgttccttgtgttgagggtgttcattccgtgttatcttcccgtcagtcatgcgtcctgtcctatgttaacctacataagaaagtgatgtgggtgtccacttctagtgaaactactgtctgctgttaaacctggttggtttcagaacgatgattttcgtgtgcaaaacagattactggtccgtgggagttgagccagtttgcattgtcttaag

SEQ ID NO: 16899 - DNA, 625 bp, Zea mays
  Clone ID: LIB3279-200-Q1-K6-H10
cccacgcgtccgcccacgcgtccgaccagtgcgaccaccacacacaagggtggtgccaaggagccgcactgccgacctgagcccggcactgccgatcatgtccacgccccgccgccgcctggtcaccgcctcaccgtccctccgcttcctcggcctgctcaagcaacccgaccacgccagcgcccaggagctggagctcgacgagcgcgacgtcgtctggtcctcctcctccagcgcggcctcctcgccctcgccttcctcctcgccgtccccgtccgccagcctccggaggccggtctccgcgccgtcctcccgccacttccccgcgggcagcatggggctgtccgcgctgctcgccgacgaccatcaccaccagcgcgcgcccaccgcgcccgtccccgtcgtcgcgcgcccggagagacagcagcagcagcgcgccccgcagccgtaccaccgctcggctcccgtcgccgtgccggcctggcccaaggcgatgcagccggcgacggacaggcgccgccgggaagcggagctgctgcaggccgcgcccgacgacggttacgatgacgccgagcccgtggtgccgccgcacgagatggccgcgcggcgcgccgccgcggcggcg

SEQ ID NO: 16900 - DNA, 629 bp, Zea mays
  unsure (1)..(629): unsure at all n locations; Clone ID: LIB3279-200-Q1-K6-H11
tttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctcctcaacgtcggaggcgccctcacgaccgtgggatgcgtggcctccatcgccttcctcatctccctgcccgcttcacgggaccaggagaggaaccgcttggcgctgctcatgtctgccgcgctccttcaaggcgcgtccgttggtccgctcgtcgaccttgttattgacttggattcgaggattctcgtcactgcgttcgtcgggaccgcagttgcttttgcatgcttctctggcgctgccatcatcgccaagcgcagggaatacctgtacctcggcggtctgctttcatctggcctctccattcttctctggctgcagtttgctacttcaatctttggccacaccagcgcgaccttcatgtttgagctcttctttggcctnctgggtttcctgggatatatg

SEQ ID NO: 16901 - DNA, 531 bp, Zea mays
  Clone ID: LIB3279-200-Q1-K6-H12
gctgcagtcactgattaccaaggagctgatcagtggggtggtgaccagtggacctctgatgtggctgcaccacctgttgctcctactggtgctgattggggtgctgcaccagcttcggttcctaccggtgatggctgggatcaaactgtggcccctgttcctgtggatggcactgttcctccagtggtcgctcctactggttgggaatcagcagcccagcccactgcccaaggctgggagtaggcgttgaggcatcactctgagacgtcttgtgcgggattattccaaagtatgaatgcccgaagtcagacgacatattttgtagataatttgctatgctttgtgcacttatgtttttagggctttctagttgaaccggtgcccctgttctgtttttaaaattgcctctatgtaagaggctgtgcagtataagtactagcccctttgttttctgtcgaccgcattgcatggtttggttcgaacctttcgatgtcgtagttctatatgataatacattcagttgattttgat

SEQ ID NO: 16902 - DNA, 646 bp, Zea mays
  unsure (1)..(646): unsure at all n locations; Clone ID: LIB3279-200-Q1-K6-H3
gcagcttgtggtcgtccctcagccgcgtcgcaccgcatcgcattctacgattcgaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttcctgatgccaccaagggttctgaccacctgaggcaagtctttggcaagcagatgggtttgagtgatcaggacattgttgccctctctggtggccacaccttgngaaggtgccacanagagcggtctggttttgagggggcctggactacgaaccctntggtctttgacaactcttact

SEQ ID NO: 16903 - DNA, 662 bp, Zea mays
  unsure (1)..(662): unsure at all n locations; Clone ID: LIB3279-200-Q1-K6-H4
cccacgcgtccggcgccggcgcctccatttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggatgttaccgggagtaggaaggctgttgtcattcacgtcccataccgcctgcgcaaggccttcaggaagatccatgtcagactcgtcagggagctggagaagaaattcagcggcaaggatgtggtaattgttgctacacggaggattgtgaggccacccaagaagggttcagctgttctgcgccctcgcaccaggactctgactgctgttcacgatggcatcttggaggatgttgtctacccagctgagattgtggggaagcgtgtcagataccgtctggatggttccaagattatcaagattttcttggacccaaaggagaggaacaacactgaatacaagctggagacctgcactgcggtctaccgcaggctgtgtgggaaagatgtggtctttgagtaccctatgnaccgaaatgcata

SEQ ID NO: 16904 - DNA, 435 bp, Zea mays
  Clone ID: LIB3279-200-Q1-K6-H5
accgacagccagatcccactgactgggccaaactcaatcattggcagagctgttgttgttcacgctgatcctgatgatcttggaaagggtgggcacgagctcagcaagagcactggaaacgccggtggccgtgttgcttgtgggatcattggactccagggctgaaaacgatcgccggacttgggggtgcctgagaggtccgtctcctgccgtccccagcagacgagcctgaacattcggagacatcgtgaaataagagcgtcgctgatctgtgatcatcgtatttgtcattatgcacctgtagcaaccgatggactgaactgtgctggattatgctgttggatcacctgagtatgtgttacatgtcggttttgatgtgacatcctatcgtttcgatgtgttttgtggaagtgttgttgcaagatttcaacagtc

SEQ ID NO: 16905 - DNA, 631 bp, Zea mays
  Clone ID: LIB3279-200-Q1-K6-H6
cccacgcgtccggtaggttagctaagctcgggatcggaggagaggtgccccgcgaccctgacgatgacgatgcctcgccgcgcccttctcttcgccgcggtgctcctcgcggcctccgccgccgcggtctccgggttccacctcgccggggacgagagcggcctcgtgaggggcgtgctcacagcggtccgcgagcgggccgaggccgaggccgaggacgccgcgcgcttcgccgtcgcctaccacaacaggaaccagggtgctgctttggagttcactagggtgctcaaatcgaagcggcaggttgtgaccgggaccctgcatgacctgatactggaggcagctgatgctggaaaaaagagtctgtacagagcaaaagtctgggtgaagccgtgggaggatttcaagtccgttgtcgagtttcgccttgctggagactctgaatctgaacccgagccttctgttgcttctgatgaaggctctgggcaaggagttgccaagctctctcttgaagcagacatcatacacgaagaggctcacctgcacaccattgagaatgatgggctttccagcgatttcgcatcatccgcttagaccatacttggtgtgactaggattccaggcaaggatg

SEQ ID NO: 16906 - DNA, 638 bp, Zea mays
  Clone ID: LIB3279-200-Q1-K6-H7
ggcgaagagccgaagacagaagactgcagcaaaaccatcagatctagcagaactctctcgacctcatcggcgttggcggagcgcgtgttgaccggagatggcgccgagcgggtggaggaggagcgcggcggcgcgggtcgcctggcgcccggccacggtttgcctgtggctcgcgctcgccgccgccgcactgacgctcgcccaggctaagaaggacctgacggaggttacccacaaggtctacttcgacatcgagatcgacggcaagcccgcaggccggattgtcatggggctttttgggaagactgttcctaagacggcagagaacttccgagctctttgcacaggagagaaaggggttggcaagagtggcaaagccctccactacaagggaagtaagttccacagaatcatccccagcttcatgctccaaggaggtgacttcactctcggggacgggaggggtggtgaatctatctacggcttgaagtttgcggatgagaacttcaagatcaagcacactggtccaggccttctgtccatggccaatgccgggagagatacaaacggatcccagtttttcatcaccacagtgacaacaagtttggttggacgggaagcatgtggtgtttggcaag

SEQ ID NO: 16907 - DNA, 644 bp, Zea mays
  Clone ID: LIB3279-200-Q1-K6-H8
cccacgcgtccgattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcctatgctgttggagcag

SEQ ID NO: 16908 - DNA, 500 bp, Zea mays
  Clone ID: LIB3279-200-Q1-K6-H9
agacactgatcggacgtggaagttcacataccttgttgttgatatcgtgtcaccaccacatgcaaaaacacaactgatgttagaatcttacttaccagcataaggatgcaggaaacagaggcagttagcagtgccatgacatctccgagattttggcacaaatgggaagctctgatagaagtggctaaactggggatttgtgaacaagtctaggcaagttgggaatttaggaacaagattgtcataatgtactaccatcaaaccagttttgtggagtaataaacggttcttacattactagaaacatatctggaaatgtttcgatgtttcttttagttacggggaaaaccccctgcatgcctggatgagggtattttttgttagttctcatgagtaccttgtatcgcccaaatacgtgggctaatccagcaagtcatcttttgtaaaatcatagcaacccttggctgttaattcattttgtctggatttggtttccaatt

SEQ ID NO: 16909 - DNA, 456 bp, Zea mays
  Clone ID: LIB3279-200-Q1-N6-A1
agagataactgagaacccaggctagggcaaatcttattataggtggtcttcttcatcggcatctatctgattaacgccttcacattggtcggggatgtgaccaggaaatgaatatacgtggttctcgggcacaaggccacacttgcagcgtctacaaccacccggggttcttgattggggggaccaccgccttcacctgcaggtagtttttcaggctgtcaacgcccttttccctcccgatgccggtcattttgtacccaccaaacggaatcgcagcatcgaaaacctcgaagcagttcacccaaacggtcccggccctgagcgcccccgtcagggtgttggccgtgtccaggctgttggtgaacaccccggcggccaatccatactggctcgcgtttgccctcttgataacctcattgaggtctttgaacttgaggatcgactgcacaggcccaa

SEQ ID NO: 16910 - DNA, 454 bp, Zea mays
  Clone ID: LIB3279-200-Q1-N6-A10
atgcctgaagccagaacaatttgtgttcggcttcaccagttggccatgcaaatcccaaacagcctagcctgatgcgctccggtcacaggaagcccatttcgtttaatcatgcatttggtagcacacttgtttaataaaaacatatactcgtctcataaaaacatattaccgaaatcttgttagagtggttgcaaaatactttgcggggttggatgttagagcctctttttaacttccaaaaatattttttccaataaacgaaaatgatgacttttttaaaattttaaatcttaaaaaaatgctcccaatctaataacttctaatgttttttcagaaaactaatgagcttgtttttctagacccccaattccaatgtcacaacacacttcggaagcaccaaagatttgcacatggccttcatgtgttgaaaagcactgatcatgtccttttctag

SEQ ID NO: 16911 - DNA, 541 bp, Zea mays
  Clone ID: LIB3279-200-Q1-N6-A11
aaccatagcaatgcattaccaccatgactaaattcataacacaggcaaaagccactggaccacttacacacaccagccaaccaccactactaccatgagaaggggcacatcacagtgcttgcttgagaagcagacaacaacgacgcctactacaagggggctaaaacgaggggaacttggtgacggccttggtaccctccgagacggggtgcttggcgagctccccggggaggaccaggcggacggaggtctggatctcgcgggaggggatggtgggctttttgttgtaccgggcgagcttggcggcctccgcggcgagcttttcaaaaatgtcgttgatgaaggagttcatgatggacatggccttggaggaaatgcccatgtcggggtgcacctgcttcaggaccttgaagatgtaaatcttgtaggtctccacgctctttttcgccttcttcctaccctttttgtcgccgccctccttgccggcggacttgcccgcaggtagccgcttctccgccttgggcttcttccccgcgggggc

SEQ ID NO: 16912 - DNA, 591 bp, Zea mays
  Clone ID: LIB3279-200-Q1-N6-A12
gaaaatcggcgttccaacatcaaaagccacaaaaattactggcggcgatacagaatacttcactttaatgaccgaagacacgatacctacccaagttgtattctcttgtttatttttgacactacagttgctatgttctatcaaagcgaaggccccatccaaaaacccaccaccatgcttacgaggggtatggtttttccccagttaccagggtgatgactcttgaagccatgatacccttggatcgcaaacaggtgttgatggctctgcagggagaaactgaatgaccgtggcagccctatgggcaatctcctcgcaataagaaccacaagcaccacaacaaagcacatgaggtcctaccccccagcctgtccctccttgggaatgtggaagccgccctcgagcttggttgtaacctcgttcactgcagcatttgccttgccatttgcattggccgcctcgtcgtcatcagcattaactgggctaagctgccagatcctaatggtgccatcttctgaacccgatgcgtatgattcaccaccaggtgcaaaccggacacagtggaccggtccatgatgccctttgttacaa

SEQ ID NO: 16913 - DNA, 584 bp, Zea mays
  unsure (1)..(584): unsure at all n locations; Clone ID: LIB3279-200-Q1-N6-A2
agatgaacatactgaaagcatccggcatggttcatacgaaaccgaagcccatacatcagataggaattggtagacagacaccgcgaccgaaggaagcaaacacgcacaccagaagcacccccactacagactacgattattcctcgccacattccacacaggtagaggtcctcacaactcgctggcactgctcccacatcttcagagccacgatcggtcgacctagtcccacctcaggcgaccttgacctcgatggtcttgggcttcttgggctcgggcgggggcagcttctcgacggtcacggtgagcacgccgtccctgcacaccgccgagatcttgtccatgtcggcgttgtccggcagcacgaacttgcgcatgaacttgcccatccgccgctccatgcgcaggtacttggcgtnctcgcgctcctcccggcgccgctcgccgctgatcaccagcacccgctcgtcctccacctgcaccttgatgtcgcccgtgcccagccccggcatgtccaccacgaacgcgtacgcgcccgggagctccttgacgtcggccggggtgaccgccatggcgcgcgcgtc

SEQ ID NO: 16914 - DNA, 345 bp, Zea mays
  Clone ID: LIB3279-200-Q1-N6-A3
aaaagggattatacatgctctcttgaaagatgagggagtttcacaacgatgaaactctggatattgttttctagacaagacaaatgtttagataatagccttagaaacaatgtgataaaactattcttaatgaatagcctaagggatggcattaacatgtttgcactgaagcagaaagctaggaaaaggcggacgagttaatacaacacaaaaccataaagcatgaactttattttacacttcctcttattctggccaattggatacacaaggtattactctactgatcaaactgaacaaacttcaccgagttgacacgctcccttcggctattcattaaaaata

SEQ ID NO: 16915 - DNA, 506 bp, Zea mays
  Clone ID: LIB3279-200-Q1-N6-A4
aagagcaaaatataagcgttgtttgatgcatatcatagccataaatttacatgggagatgtgagttgtgacataaccagaaaatagccatgccaagcatgtgtccaagcaacaacagggcaacagaacatgcattattgcattcaaacaaggcatgagttggtaaggtttgttaaactgaatgctaaactttcctccaagagtactcttgtgttttcctttggtgattgcagagctagcatttataggaaaacatgtatgcgcctatctacaatagcagatgtcgtccacagcaccaagttcgtccattgaaaagggacctcaactctggtggctaccctaataaaattgtgccccttcctagaacaccaactccaggccatgacaagggttgcggagaagaggccgctgcctcacatgccatcatgtcatgcagcacgtcatctctccttctgcagaagcaagacaaaagcctgaacaagggagttctccaacctgacttttgta

SEQ ID NO: 16916 - DNA, 428 bp, Zea mays
  Clone ID: LIB3279-200-Q1-N6-A5
aattaaaattttttaaaaaaaaaaatattttttttaaaaaaaaaaaaaaagggagggggaaaattttgggaaaaaaaaaaaaaaaaaaaaaaaaggaaaaaaaaaaaaaaaggggtaaaaaaaggaaaaaaaaaaaaaaaagatggaaaaaaaaggggaatttggaaagaaaaaaaacacccctaaaaggggatggggtttggttggttccccccaaaaggaaaaaaaagggcacgaaaaaaaaaaaaaaaaaaaggggggggggcccctaaaaccaaaggatgtcacctttttaatgggggccgaaaaaaattggttttaaaccaaaaaaaaagccgagaaagcttctttagaccccccaacaaaatatttaaaaaaaaagggggacccacccggggggggaaaaaaaaaggcgcggggggggcccc

SEQ ID NO: 16917 - DNA, 575 bp, Zea mays
  Clone ID: LIB3279-200-Q1-N6-A6
aaaattaaagagacaatccagattgagaagatatatttagtcgcagaacactttaatttttagcagaacaaaagataagtacttccatgcataacgatgttcagcacgagataagcaggttcacacaaggcactgtaataccccatacacttaaaattcatgttgcacaaagcaaaataagataggctaaaccaaaacgtctggattcgcattccaactgtagattggacttaagcaacggcctcgaggaaagccttcccaggagcacgcttctcaagtcttccatggttaccgagcagctttgcgttgacaccatcaggaacaattctaccctcactcttgtacttcaggtagtcggcacggctgaacttggtgaagccccactttctgctctcaataatcttttggcggccagggaacttgaacttggcgcgacgcagagcttcactggcatgtgcagcattgttgtccttgcatcgaacagaaaggaggacctgaccaatgtccaccctagcacaggtgccctgaggcttgccaaaggcacccctcattccagtctggagcctatcagcccc

SEQ ID NO: 16918 - DNA, 485 bp, Zea mays
  Clone ID: LIB3279-200-Q1-N6-A8
gacaaaggaaagaaggcttgcattatttaaagtacaaactcctagacaggggcataaagtttcaatggagagtcttgtggatagctgagctatttcaaaaaatacaatccctaaccttttttttttgccctccatcactaggaaggatgtgtcatcttgttaattgggcactggtgggtctcttttctgtcctgggatggaatagcttcgctattgatcgtctctcacaatccttaaacatattgaaacggaatggtctgtcaggatttgtccttctcagttttaagtatgtatatgcaaagctgagctggtcacgaggtgtgaatcgatcaacttcattgtaccacaggcaggaaaataagttggacatcggtgtgtgctctcttgcgataaaagagccttcagggacataacttggtaaaagcctgctgggatccgatgggttgaaccttgtcagtccatccgcttgataaaactcaaattgc

SEQ ID NO: 16919 - DNA, 597 bp, Zea mays
  Clone ID: LIB3279-200-Q1-N6-A9
aatcacaaagtgcaaggcaatttttttaaggaatgacacacagcagcatcttaacatggtttgctcagttctaacaagtctcaactgttggaacatagataaatataagctgggactacgagcaccaacatgccccctgacagaacacaaacttagcgcttaggactgcctgttcttcttcttgacaccggacttggcaacctggaggctgcggtacaccgagcttagcctagcaagagctggcttggtcagatcaggcctgtagtagttgtcactaacctggtttttcacagccttggccatcttgcggaactccttgcgcatcacagacttgtggctgagcttcgcaggtgcgttctgcttcttggtcttggtagtagagaggaccacagccgagtcctttgcagctggctggatcgtcacagtcttcttgttcgccaaacccgagtgtttgaaggagtggatgttgtagaggttgttcggctccttggtgaactgcaccttggcattgccgttgccgaactgcttcacaaggaaggagttgttcttcctcacaacctgccagatcagatcccctggaacggttgccatttccct

SEQ ID NO: 16920 - DNA, 596 bp, Zea mays
  Clone ID: LIB3279-200-Q1-N6-B1
ctctgcaaatggttgtctggaaggtcttcatgtggctccaccactggatttttgcatcctttttcaatgtggccatactggaagcacctcttgcattgatatggccctctcttacctggctctccagcactcttgattcttttctttcttggtctgccagcaggcctgccctcaagttttggtggcctcatttcgaatcctgggtccaatttcggccactgtaacctgtctcccattggatacacctcaaattggtatgcatctttaaacctttgaaccgaataacattctccaacatagtcctcgattctcaaatttcgttgagaagttatgaatgctatggcatgagtgcatggttttccagttacatcccactgtccacatgaacaagcctgagtaacaaggtttactccatatctccaagcaacaccatctctactagcaccagaaacctcacccttcatgtacccacttttagtgatggtatatcgaagattcctactcttctcatgcagatcattaactacactaggtaggatgtggccttgcattttattggctatggactgtcttgtagcaatcttctccattatcat

SEQ ID NO: 16921 - DNA, 562 bp, Zea mays
  Clone ID: LIB3279-200-Q1-N6-B10
gggaatgcaggccactcttcatatatgagatggtacgagcactgaaaaccactggaaactggaacatgccaggatcgacaagcctggaagaattcaatgcagccacatttcctatccatgcgtctagcacggaacagcgaaccatgtactaaaccaaacacttaacgagcaatgtttcagaaaagccggaagacaatagagtttttgaacattactccgaacaacacacactacataaagggatcgagtctccgttacacgaaatcctggaggacgaatgcagctatgcacgcaggcccctggatcttttattttatgagctaaaatggcttcgagccaaggttaccatgggactctacttgttctgcagcaaggacaccgctgccttatcagtgaaccaggtgaattctccatcttgcagcacaggcatctcaacaggcagcaagtctgacgaggtttgcttgtctgagagcgccttctgcaccgttgccgcctttgcagctccagtcaccaccatagcaacgtatgcggatgagttgattactggaaacgtgaatgtaat

SEQ ID NO: 16922 - DNA, 565 bp, Zea mays
  Clone ID: LIB3279-200-Q1-N6-B11
tcgcgatctagagcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtggggttcggttggtgctgaatatgttgttgagtctactggtgttttcactgaccaggagaaggctgcagctcacttgaagggtggtgccaagaaggttgtcatctctgctcctagcaaggatgcccccatgtttgtcgttggtgtcaacgagaaggagtacaagtctgacattaacattgtctccaatgctagctgcacaaccaactgccttgctcctcttgctaaggtcatcaatgacaagttcggtatcgttgagggtctgatgaccactgtccatgccatcactgctacccagaagactgttgatgggccctcgtctaaggactggaggggtggaagggctgctagtttcaca

SEQ ID NO: 16923 - DNA, 442 bp, Zea mays
  Clone ID: LIB3279-200-Q1-N6-B2
agaaaccgcaagctcaccattaccgacagaagtccaccacaccaaagcagctggcgaacaatgcgctgcttcatgtaacgtgattacataacttctagctgacccgaagaagtcgcatttttttttgaaccgtttagaccaccccaagaaacaatcagaagagaaagtagaccccacatcacatacctaggattaacaccgacttacaagctttgcctatcactagctaccataaacctttccatgcagctgccatgtcacgaccagacttgatttcaaccacctgcgaaagcagcagcgccatggacaaaagaggacagcagcgactcacttgatgtactgagacatccatttgaagccttcgccatagcccatcttgcgcaccacactgcacatgaagatctccaggggccggacgttggagtcggccaagttcacgttg

SEQ ID NO: 16924 - DNA, 570 bp, Zea mays
  Clone ID: LIB3279-200-Q1-N6-B4
gccaaattcattgctaagatatagattattcagagccactactacatagtaaatggaccacttgcaactgcttgcaggagatccatcacccagcacggacacttacgactaagacggtgacacaaaaacgacgacattgacttctgctacggtggtgtcaacgctaatcttgctgctaagctattacagacttcctagaagccaattgaggagcttattcagaatgttctggaacttgaaagatgcacgcatcatcccaacatgaagctccactccaccatcttgttcacttgctggggggacagccattgacctgacgctgcagctgaagcatggtctgaaacttgtcacgcaggtcatagaagttaatcttcactgtctccagtgtcttgaggcacccatctttgctcttctgctgacaggattcgcggaactgaatgcaagtgttcttaaccttctgagcaccaatacttgcactgcttcctttgagctgatgcacaaaggcgtcaaccctgtcaaaatccacgttgggcttctccagcagtttggccagctctccgatgatccgcg

SEQ ID NO: 16925 - DNA, 571 bp, Zea mays
  Clone ID: LIB3279-200-Q1-N6-B5
gattcgcaattcgcatctgggttgctcgccaaaccaattccgagcacaaaaaactggcaatgtttcttactgacatctactagttataggtagaccgcatcaccaaatccacatgtgacagtgacatatcgaaccagagagtggaagctagaaaacctcagatgaagagcgctacaacactcagaaccggcgaaccgaagacctggggttgaccctcctcaccttggtggccatggaaacggcgccggacgcggcggaagccttcttcatctccttactgctcctgagcgaggacctcggccccaagtctccaccgcggcatgctgcgaagtcgacggctggcatagacctcctcacggactccgcgccgctggcggcgtaggccttcttggctacgcggcgtttggacagctcgacggcgacacaggggttctcggccatcgtctcggggtccactgccgcggacgcgaactcctcggaatagaaggggaagccctgcttgcgcttgagccgctcgttgcggcgcgccgagtagaggtcgtagagtctgccccgcacgaagagcgggcca

SEQ ID NO: 16926 - DNA, 560 bp, Zea mays
  Clone ID: LIB3279-200-Q1-N6-B6
gagtgcttaaaccgcatccaccaaggatcattaatgacgattctttgtatgcaaggtaaactccagcatcaaatacatattacataatgctttacacaggcgcgagagctatatagctcattccagtaccatctcggcattctacttattccacgtcgacttcctcatcatcagcctcgtactgctcgtaagtattaaccaccggtggtggttgtgggggcataacaggcgacctagtttcgtcatcagcatcattttctattgatgtgtcacgtctatcctccagttcaacagcttcaaacagatcgtctaaagcatgagcagccataccagtggagggcaaaacatgtttgaccggagattctttgaccttgtcggtgttggctgaggagacaaagttgcctatcttatccttttcatcttcccacagttccttcttcaaatataaagattttgttggctcggttcccttgcttagtttttcaaatcctgcaatagtaccttcaaacctatatttatctggcctagttgtgtcagagtcccgctctcttcttttcttc

SEQ ID NO: 16927 - DNA, 79 bp, Zea mays; identical to SEQ ID NO: 8405
  Clone ID: LIB3279-200-Q1-N6-B8

SEQ ID NO: 16928 - DNA, 586 bp, Zea mays
  Clone ID: LIB3279-200-Q1-N6-B9
agactacaactagcatccattaactcattcaacttaacacaaactagctcgaacacgcgggctacgctgcacggacttaggaagaagcagcgcttgcattgctatgctacattatttcgaatagtaaaagctactgcggataagaaactacagtgcacacggcgattctgaacaatgtcaaacaacgtgagcagtgccagacggatcgcatggcggcctccgatttattcgtggacgacggcgatttctccgtgttcgggggatcatattattccggccggagatgcgggaacgacgacgctgcccatgctctccccgcttgcggtggcacaccccttgtcgtcgtgcttgtgcaaaatctctcgcgccagtttctgcaccgacgcgtccgacgacccgccgctggccacgccgttctggctcagggccttcgcctccgtcgccttctcccgcgccttcctcccctcctcctccgacccgcccatcaggcaccggaccgcgcgctccagctccgccgcctcgacgaagttgccgcgctttctgtccacctgcatggcaacggcgacgcccatgacggacacgagct

SEQ ID NO: 16929 - DNA, 519 bp, Zea mays
  Clone ID: LIB3279-200-Q1-N6-C1
aaaagcatcagagtccacaagtaccattaccagggaaatgtacattactcagcgaaacagcagctgagtttcgatacgacgcgatgccaagcataaaccccaatccaaatccgtccccaacactgcccccaacaaacaaacccaagctaaattattcactgcatgcaatacgccaagtacatgcacgagctcacggattacagaaccaaatgaggcgcaaactttggtgcccaaatgaccaaaacagaacatgacgaacttttaaaagccctgctcgatcaggtaatcgccgagcctctccaccaccatgttgcattgccctggagtcattggctcgtcgtagacaccaataatcaaggacatgccggttttcttgatagtaatgcccccagtgcccttctttcctcggatgacaactccaggttcaccttggatcaccatgtactttgtacctccaacgaaaagaccagttggtgcaagagtaccaggttcatcaaagtcctttatgataccagcaac

SEQ ID NO: 16930 - DNA, 592 bp, Zea mays
  Clone ID: LIB3279-200-Q1-N6-C10
aaaaacaatgtaaatggattttccgatttgtatccaaaatctcgaagttacatggttcactactgaatccaaaaggactcccagcaaaggcaatcagtagctgcggccccaaaacgaccacttctttgctggctttccagatgcaaagcacagggtaccttctggaagttctggctgctcaaatggagtacacaatgttttcgcagctccgagttccccttttgtccgagctttcacatctttctcaacttcctcctcatcgcaccaaggagccaagatcaaccttttgttattcagagcaattgtgaattcatcccaagagttgacgacctgaacacatgcatctctcctttcttgagctgttttgaacagatttttttgaatctcatccaataacactttaacatcttcaaccaaattggtcaccggaatgtcaacctttgcaccgttgtcccggcggacaatgcgtacctgtttgtttgccagatcttttggaccaatctcaattctcaatggaacacctttcatttcccagtgagaatacttccaacctggagagtaattttcaacgggtgtcctgatccgctcgaat

SEQ ID NO: 16931 - DNA, 589 bp, Zea mays
  unsure (1)..(589): unsure at all n locations; Clone ID: LIB3279-200-Q1-N6-C11
acgatcacaggaaggtcatatagatgtcgattattaactgcagattccattaccatttgaagttcatcacaagatcgtcagtgatcgtcgccatccagggaactgaactttgcaagaccaacagaaaggtaaacgctgcctcagatcaggcagagacggagcaccaccagaaagctactagtactacgactgctctgcaacagaaacgactactgcactccagtaattgaaactactaatacgactagctcatggcaactacgatatggatatggactgcaactacggtatggatatggactgcaactaggagacctgggaggacccatccgatgcacacaccctactcgatcttgatctcgaagacgtccttgcgctcctcgtccttgatcttcgggacggtgaccctgagcacgccgttcttcatgtcagccttgatctggtccatcttgaaagcctgggaggagaggccgatgcggtagctgtaccgcgccgggcccttgtcgtcgtcgcctcgaggtccttgccggcctcccccttgatcaccagggcgtncttctccacccgcattttcacgtgctccttcccc

SEQ ID NO: 16932 - DNA, 591 bp, Zea mays
  Clone ID: LIB3279-200-Q1-N6-C12
aatattgaactgatttgaattttcagtattgtacgttgaattgtatacagtataaggcagctagagatggtgtgacattcagtatttatactagaaaacgacgcgcggcgttgccacgccgtcgcgcaactggttaagatagttcgttgtagaaaaaaagatgaacattagacctagccacataggagtgcccttctagcgatggaggagtcgtcgccacgctacatgcttatatacatcaaaagatgtagctttatttgtgttctacgaaacagaaattataaaaatatcatactggtcaaaaggcttttctaaagtctactactttttgtcttcttggtttatatcattcatcgttttttacatttcccttgagattggacccttttgattttttgtttgttgtggaagatccttctcatcaattatttcctttttctgagatccaccgatcttatatttgctcgtcgttactttagattatcctgcaatagatagtattacagaaaaaagaggaaactatattcatgtcgcaagtagaaaaagagagaagtatggagaaatgcttgagaaaaacatgaagcagcaata

SEQ ID NO: 16933 - DNA, 570 bp, Zea mays
  Clone ID: LIB3279-200-Q1-N6-C2
agcaagcattgattggagtgaaaaattaatgtctgaacgtaaaatgttcatgaatcatgatgccagtacatatccatcttaaaatacaacctactagttttaaaaaagttgtatacatgtcaagggtcaagaacgcacagacagcatggggccttctgttcattatagtttcgtacgtgcacaaataaagaagaatgcatttgagcttaagcttcttctacctctatcgagcaccgaacatcctccaccgtaggccagacaatcagtggtttcccgattcctagctgtgatccatcatctgatttaccagctgacagcgagcatgcaaattcactcatccatttctcatcaagtgaccccagggaagaaaactggtaaatcagaggggatttgcaaaattgtttattgaacatgatttcatccagaacattcctaagtttcatatggccccacttcctaatattggagcccacatgataaccaggaaccgatccaatcaacctgaccattgaattactatagtcaaacttcctaaagaatgccgcattgatgttgacatcaccaacccct

SEQ ID NO: 16934 - DNA, 435 bp, Zea mays
  Clone ID: LIB3279-200-Q1-N6-C4
gcccagcaaggaataaaattattgcccccagaaaagagaagcagatttcttttcaattttttggatatacagatgcacttggaatttcgaaaataagacaagatgggccctgattacattggcggcaatatttgctggggctgttacagtgcaatttctttcacatgatatactgaaacaatcctcagtagccaaacacacactgagctgcctaattttacaacaggggtaacgcgatgaaacctatatgatcagtagtgggtcctgacacgataactcgcaagtaagtttgctagcatcaggcgggcctctcgccaccatctagcgcagcaaccttctgtgaactactttggtcaacatccattggcgtgcttgtcctgggaggtgatggtggctggacctcaacatcagggtaagcagctttgtaccttgctc

SEQ ID NO: 16935 - DNA, 421 bp, Zea mays
  Clone ID: LIB3279-200-Q1-N6-C5
aacatgccaacattcctacttcaccgtccaatccaatcccatcgaaccagcggttcttacagacccaaagaagcacgactacaggacgacaaagcaaccagctaccacaactgctacaatacgaacacaggaaggcagccaaactagtaccacagatccgagacacctggacaggcaattacccacacctaacctagccgccgaagccatagagagtgcggccctggcgtttgagggcgtacacgacgtccatagcggtgacggttttgcgacgggcgtgctccgtgtaggtcacagcgtcgcggatgacattctcgagaaagatcttgagcacgccgcgggtctcctcgtagatcagcccggagatgcgcttcacgccacccctcctcgccagcctccggatcgccggcttcgtgatccc

SEQ ID NO: 16936 - DNA, 392 bp, Zea mays
  Clone ID: LIB3279-200-Q1-N6-C6
aacacaagaacatactggagccttaagatcatagatttactcgtttcagttgcatacagcatcagagtctaggaaaacgaacaaaggggcccacaattcaagcctaagggctcaacattgacaaatttattacgagaaagacaatacgacaatttggttgttcacattgactccagatgcaaaagaccacatgcagcagaatgtttcactccaggatagggtctatttaagcatcagcaaacctgctttccacaagagtaaacgatcaaatttgttaaaattgaccaagcacaatttgggcaatcaatggttaccccagttcggagagcttgaggggggcctttttgtagtcatcaaaaaaagcctttttattctacaagcggacgcgtggg

SEQ ID NO: 16937 - DNA, 596 bp, Zea mays
  unsure (1)..(596): unsure at all n locations; Clone ID: LIB3279-200-Q1-N6-C7
aattgagaaatcaagttcgaaagcaactttttgcatacatcaccatagagccgtttggtttttttttcatcacatgctcatcgcacctccagatgcaccacgaccaacacacacactcatgttcttcatcacaagctaaacacactcccagaccagatgcacgaaaagaacacctgttcactgtccaacaaacctttgcttgctgctcacaaaacctgactgcgacataaccatcactgggacccattgaacttggccatcatctttgcgatgatagggcccaccttaggattcgcttggtgcttagcaaagttggcaggattgttcatcacatcttgtaaagccgccatgacctctgggtcactgaatgctgccatcaggtcagggtcattcaggattttactcatatcaacattaccgggaacaccaccagggaaacctccaggcatgccacccccggggaaacctccaccgggcatccctctagggaaaccaccaccaggcatccctccaggaaagcctctgggagatgcacctcctgatgagcgacttgacgattgctccttcctcttgngccttgtcgtaagcagcctgcg

SEQ ID NO: 16938 - DNA, 555 bp, Zea mays
  unsure (1)..(555): unsure at all n locations; Clone ID: LIB3279-200-Q1-N6-C8
gtcctcgcctcaaattcagtagtttattcatataatatatcactgaacattacatcctcgtctcaagttcagtagtttattcatatatcactggaacatcacagccaggcctaagcaataaagtttacacgttgaggcctaactggtcataaaatacatcagagaccggagatcgctttcagtagttcgttaagattttgtctcgtgagacaccatctgctacaagggataaggtgagttcctcctgcatttcattcggtccacaaagtatggctcctgtagaagatggatttactatgttcttgtttctgaagaaagcatcctgaacatatcctcgttcacctttccagctgtcatctggttgtgataagactggtattattttaattccagttgactcccagttactaagcctttcctggtatgacatagatttcagacttgtatcaccataataaagcctcacatcagctctttctttggcagcgaaaccgaactcgataagtgatcgaatcgcactgatccccgtccccgccgcgaagatgagcacggcgn

SEQ ID NO: 16939 - DNA, 583 bp, Zea mays
  Clone ID: LIB3279-200-Q1-N6-C9
acttatacctgagaaatgcctagtaaatgaaagcgaaaaaaatgactgggtatgtagggtaacattgatatgcagaaaacgacgcgcagcattcgtggttggctagctatcaatctatcatgcagagacggggtggaaggcgatgacggagtggttggcaatgtgcaggctgaactgtcctcctttctcgctgacgtcgagcttctccacgccgggcggtggtaccatctggaagctgcgcacgagcttgccgacgatgagcgcgaggatgggcagcgcgaggatgatcccggggcagctgcggcggcccacgccgaacggcaggaagcggaagtccaccttcccgccgacggtggcgtccacgctcttctcctcgcctaggaaccgctccggccggaactcctcgggcttgtcccacagctccggattgttggccagccaccacgcgttgaccaccaccttggagcccttggggatggtgtagccgccgagcttggcctcctcgaggttcatgtgcgggacgaggagcgggatcggggagtggaggcgcagcgtctccttgatgacggcctgcaggtagggg

SEQ ID NO: 16940 - DNA, 486 bp, Zea mays
  Clone ID: LIB3279-200-Q1-N6-D1
cccacaaatgaacacagtttatttgctctgtgcaggattcaaaggtttccataaccaggaaaaaagtttccacaaataataatcggggtccaaaagtgtgataaatcacaattgagagctgccaaagcttttcctggacatcgtcagggtaccccaaagagtactgggccacgttctcctttcaagaattggctacccagttacctgcccaaaaaggctttgacaaatttttggcagcttttttctgaaaactacctgcaatctagcatccagtgtgttttcacagacaatttttccatctcgggaagctagcacaactccaccggagcatgagggaccaggtgcctgataatgactgggagcaaatggcaaataaatttgacgatctaccactatctcaggaggatatacttttgctttatctgcatactcattccttgcagactccaaaactaaatcaacaagttgaagatcctccttcctgca

SEQ ID NO: 16941 - DNA, 572 bp, Zea mays
  Clone ID: LIB3279-200-Q1-N6-D11
ggtaataatatagcaaccccatgcaagaacattgcatatgatatgacaataatatatcaggtgattcaggtcatcatccaacctggaatatctatgtcaaggcaagcaccaaagaactaaactggggcatctgtctaccacacaccgtacatgcatgcttcgtacaatcggggatgaagcagcagccagcaggtgagggagcgggtgcgcatcaggatcagcctccgcgcgcctccctcctggtggcgtcgtggaggatgtcgatgtccacgccgtcctgcgggagcagcacgtaccgcaccaccgagcccctgatgaagcagttccgcactgaaagcatgtggggatacttgtcctggtcgactacgcgggtgttctcgagcttgatgttgaggtactggtcaaccgagtggagcgtcccgcggatcgccaagtcattcttgagctccactgtcacctccttccccaccagctccttgaagtaggagaagaacaacatagtgtctcttcctactgcctgctcagttcagtcgaccccagatggacgctcgtcgccggggaaggacccagcg

SEQ ID NO: 16942 - DNA, 469 bp, Zea mays
  Clone ID: LIB3279-200-Q1-N6-D12
gggggaaaaaccccggggggccccgtttttaaaaaccccccccaaaccccccagggggggggggttttaaaacccccggggggtccccaggggggggggggcctaaaatggggggggacccaccaaggggttttccccggggggggggaaaatttccttccaagggggggccgtttggttcagtttggaccccaaaaacaaaatttccccccggggaaaacccccctggggggccaacccggttgggccccgttgggccttttgggggccccattggcccccccctgggttggggggcccccggggggatttaggaccctttggaaaacaagaaaccccccccccccggatatgtttagggggggggccccccccccttctcaaggggaggaagggggtattttccaggggggggggacaaaaatccgggggggccccatccccccccctaagggggccttacgggccc

SEQ ID NO: 16943 - DNA, 480 bp, Zea mays
  Clone ID: LIB3279-200-Q1-N6-D3
aaaccaatgaaaaagcttcagttagaaaattcaatgccagaaaatcaattcttttcacaagggacccccaggtccatggcccccccccaaacttttttttccaaataaaatgccctgcttaattgatattggttcgatgttaaaatgaaatccttgaaagcatccctcaacaggaaagggggggaccataaaatgaatggttgtagggaaaatacttgcccattggatgggcactaactttatcatgacaaaatctgcaagtgaatagcttattgcagcatgcaacaacaagcttgcagttttttttgtaatgctcacacccaaatatttgtttccctgggtctcgggacaaaggaacacatccaggtcggcgggtacatccattatgtccttcaacccttggttggggggatttctgctgagcagctttccaacggctggtcatgaaattttggatcagataggccttcctccttggat

SEQ ID NO: 16944 - DNA, 552 bp, Zea mays
  Clone ID: LIB3279-200-Q1-N6-D4
gggggataagcgacaaattagctatcgttcagtatacatagaaaggtgtctccattttcatctggagttctggactactcaatattagaaaacaatggtttaacgatcattttttttaaaaaagactacccatattacattacaaacactagtctgctctatatgatacggaaaatgaaatagcattaccccaaacatttaaccatgtaaggcccttttagctcataacccaacttgcggtagtagtggcgagtaccaacccccgaaatgacagctaatttcttcgatcggtgctcctttcgagcaatcctttctgcttcttccattaatagagttccgtatccctggtgctgcagtttgtccacatcacggccatgcacagggactgcagttccatagacatgaagctcacgcacaattgaacacctccctacaagttcagggcatgtaacattacggccacatttacgcaagcgcaacagcccgatcaggaatatcctgtcgtgtatcctcataagagagggaatgtttcccaaccctcatttgcagcat

SEQ ID NO: 16945 - DNA, 361 bp, Zea mays
  Clone ID: LIB3279-200-Q1-N6-D5
accaaaaaatatgggtcgcttacgttcacagcataaaccaacattgtaaacctttggtcctccgacaagccattaccatgttcatacaaaaaagcaacaattactcataaatctaagtagagaggccctttcgctgtaacgagatagaccttacaaagatcccaaaacactgaattttcttaagcagagggggcagcaaaagccttgacgggggcaaaaagcttggacctccttttggccaaacttttgctccgggggtccctttgttcctttagcctttgggcaaaaagcttttggtactcaacagcctcaaacttttttttaattatcctcttttttttgtcagcgattttaacaccct

SEQ ID NO: 16946 - DNA, 591 bp, Zea mays
  Clone ID: LIB3279-200-Q1-N6-D6
agcggcaaaaatggatttgctattttgttattcgatggccttaatgttctcacagactgacctatatcagcatcgggacccagcggcccacttaagtattacacggcccacttgagcccattcaaacgaacgttggcatgccttccgtgcgatgacggccttcgctctcttgttgttgctcctcgctgctcatcttcttgctcgacgtcgaagactcccttgcaccttccgacgtcacggggctaacaacgccggaggggatgtcgttgctcttccactccatcgctgatgttcgacctttttagctttaggattcaatatggtcaggatttaacggcaataacaacacacggtagaccactctaataacacgcatctaaaaatagatattataatgtgttctacaagacacacttttactattattcttaatattttagaataaataaaatatcagtagtgacactagtaagactttaaatttctcctcgaacgagcaaatgatgaatatggtacacaattaatatagtattagcgctcttaatttctagctagtagtcatataggaatataagctcatcggacgcgtgg

SEQ ID NO: 16947 - DNA, 586 bp, Zea mays
  Clone ID: LIB3279-200-Q1-N6-D7
gttcagttgctgtataaattaaagaatagaaatgggcccattaaacaatatggccttctgaagtgagacacgaaaggaacatcgccgaacaaaaataatacgataattcacatacctaagattacaagtgaaacttttatctttacaatggctgggtgggtgcagagacacaaaactatcacacaggcggcatgtcgcatttcctcgttatcgtgtcttctttaggattgctgatgttcgcatctcagcatcctccttggcaaagctccaccaaaggtacgacagggggatagccacagcgaggcagatagcacggccatctgcgtatccccatcgcggtggaatgtcgtaggcttccacaagtactgcaaccgcacctccgacggcgacagatatgatcttgagccgcgaacgatgcccactcatgacagcccacagtgcccacaggagacactgagcaatgcttatcacagtacaaaccttcatgtttaggcctttgtcaagctcatagaagttgaggtacagaaatgtgggttgtcacaaatgccagaataggagcggcaaccatgactctagaagcttcgtc

SEQ ID NO: 16948 - DNA, 566 bp, Zea mays
  Clone ID: LIB3279-200-Q1-N6-D8
attgcaaaagacgttcaaggtctaacatcaaattttattctcgccgaacagttccggtgcaatgtgaggatcagctcatctgacgtgcagggtcgaagtaatccctccattctcgaatatcagtcgtccgctagttcatgtttgaactaaaacgcgacgaataaaaaaacggagggagtactttacagcagaaacaccaaaatcagtttttgttctgagagccctcgacgctcttcctcagcacagatatgatggctcctgggtccgcagcgccaaatatagagcttccagcgacgatgcaattggccccagcagatgcggccacgtctatggttgaaggacctagaccaccatcaacctctatgtcaagggaagggtacttctttctcagtgtgcgcaccttatccatcatttctggcataaatttctgaccaccaaaaccaggctcgactgtcatcacaagaaccaattctaccggattttctgcttccaccaggggaaaaacttcctccactggagtacctggcctcaatgatacaccaggccgcataccctttgatttaatg

SEQ ID NO: 16949 - DNA, 565 bp, Zea mays
  Clone ID: LIB3279-200-Q1-N6-D9
gaaacaagaagatgactatcacatttgtaagctttttatttcgtttgaaccaagtacagcaagctttttcatgtatggaatggctacacatgctatccaaggagaaatgtaaatacgtctctcaatgagatgattccttccacaaatctggtactttgttcaataacaacaagccgtcgcactcctggaatggacaatccctccaaaacttccagcaaggtactcgtctgtaaacaagtatgacactgtcttcggccatgcacctggtattgcacatccaaagcattttgtacggtcacttgttcaagttcgatgcgagcataaacatcattcttcgccagagccatgatatcactgagtgagtagacatcacggagggatccattgtcatcaactataggaattgagcttactctatcttgaagcagaatatccaggcaggtatttagaggagaactcagtagcaaagttctgagttgcctgctacttgacctccccgtatgtggagaccatgtaccaataggaatactgagaagctgattgtgcagaagggaacagccctcag

SEQ ID NO: 16950 - DNA, 91 bp, Zea mays
  Clone ID: LIB3279-200-Q1-N6-E1
attcactctcgctgtcgtcgtctttacgctcaccgcgcagccatggcggaacagactgagaaggctttcctcaagcagccaaaggtttttc

SEQ ID NO: 16951 - DNA, 380 bp, Zea mays
  Clone ID: LIB3279-200-Q1-N6-E10
attcctctcaatcttttgttttaaatattatatataatacaattcacaatattacattacgtctaatagcagtatcatgacggcgatcgccctagtatagtacaatctacaactcttttaaaatcatacaacacagacagaacacatagctctcgccacaaaagcaacgaaactatttctaaacaaatgtgcatcctcttcaaaacagacgttcaagatgatctctaagtctagatggttaggatacagtagatgatctcctctcataatattgaatgttgtggttgtattctaattattaatcctgacatcatgaattatgggtgctaacatacagcctcaccttgattgattgtacaatagattgtcgcatcgctaca

SEQ ID NO: 16952 - DNA, 527 bp, Zea mays
  Clone ID: LIB3279-200-Q1-N6-E11
gattcacaaaccatggatgcattggaataggagcaagatcccataaactggttcgatacataaaccctggatgcattggaaggagcaaaatcccatgagctggttcgatacataatactttgacatgtctattaggttctacatgtatggaaaatcagacactggaacataatctctggcaggctccatgaacttgaaatgctctctatttcttcttgtcagtgtgcgtaccagccgacctcattttcctgaggacgcccgccatctcctctctcttcttctttgccctcttgtgagttccaagctttctcttagcaagcttcagggcacgcttgtccttgccaaccttcaaaagctcagtgatacgcttctcataaggagcaaacccagcaacctttttgatcaggcccctgaccatagacaccctcttcgttgatttccccttgcggtggcacgggcggggaggcagctcgcgcttggtgacgacatgacccttgttgatgccaacgaagaggcccgactttggc

SEQ ID NO: 16953 - DNA, 579 bp, Zea mays
  Clone ID: LIB3279-200-Q1-N6-E12
aacagtagcatacgaatacgatacaacaatactgcgaatctctcagcagtttcagtacagagtcgaaagggggggggggggggagaaagaaagaaagatatcggacgaccaaactagtaaagataaaagatcagcacataataatgctggctgctgccaagccaaattatacccaatcactaagccggcatggcatgggttgcagttgcagcggcgattgccaaagcccttcttcatcatccttctctccgttcatcttctatggagcagcagccagtcactgatcaaacacacacatccagcagcagcaatgcttgcaggtaacagcagagccagaggaaggtagtcctcatgtccacagtgaacactcccaaccttaagccgatgccttgtcgaacttgaggggcttcaccacctcccaggtgaagtcggcgtcgtcacggccgaagtggccgtaggcggcggtcttgatgaacctgttgccgcccttcttcaggtcgaggttgatgctgatcatcccgggcctgaagtcgaagttctccttcacgatcttgaggatctccttgtcggggatcgtgc

SEQ ID NO: 16954 - DNA, 360 bp, Zea mays
  unsure (1)..(360): unsure at all n locations; Clone ID: LIB3279-200-Q1-N6-E3
gcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgncaccaccaccgtagcc

SEQ ID NO: 16955 - DNA, 595 bp, Zea mays
  Clone ID: LIB3279-200-Q1-N6-E4
aatctaacattacccaaactgacattatgacaatgttagccgatgacgacgacaatggaaacagtaatctaggtacaagcaggcgcctctgctagctggcaagtgtgaccacacacaaacacaccagaccagaggcagaaccacccgccagtggcgccaacgaggagcgctatccgttatagcacgacaaaagtaaaaataaaacatcacgatgtggagtgaaactgaataattctagtacatggatataggctccttttttttgatcgccacggggccttgtgtagccgctccattgttggatgaagcaccgtccattgtctcgagcgagctctccatcactcgtcatcatcttcatcctcctcgctaccctcttcgtcatcctcgtcattgacctccgacttggacttgtcagactcctcttcgtcttcctcctcttcctccttggcaggagccttcttagctgcagtgctctcgcccttgttgtaggctgcgatggccttgttgtactctagcttgagcttgttagccttggctacatagggagccttgtccgactcgctcagggatttccacctgtcgccagcagcttttc

SEQ ID NO: 16956 - DNA, 79 bp, Zea mays
  Clone ID: LIB3279-200-Q1-N6-E6
gcagtcaagcgaccattcattcatcatctaaatatataagtcagcccagccagtcgtatatccagatacaacaaccccg

SEQ ID NO: 16957 - DNA, 593 bp, Zea mays
  Clone ID: LIB3279-200-Q1-N6-E7
gaaccagaattattcttgcgccacgttaaaacagacgggcgttgtctcaggtctcggaaagcatcactaaacatgtagtagcatatatacacacatcgccggtcgcataaacacacaaattacgcgtttgcctctggacgggttgctgccaaaccatatccctaggccgactctgcgaagccaaccctcagcttgccatagtcgaagacggtgtggtagactcccatgaaaacatcacccaagatccagagagggccacggggtggtgggatatccatagctgtgaatccgctgatgcactgggcagcctgtccttcaccaaccttcagaatgtactgctctggtttcagcttgaacttcttgcctccaatggtgaacgcaatgtcaggcatggacgcaagactgccacagtccacggctgattctcccatcggactcggaagacgctcgcaaagctgattaatgtagttcaggatgagctcctgtgtcttgttctgggcaagttggttctgcatccataccacagccatctcacaagcattgcacaattggatcactcttgagaccaccatttgatttcccagcttcatcat

SEQ ID NO: 16958 - DNA, 519 bp, Zea mays
  Clone ID: LIB3279-200-Q1-N6-E8
agcattaaaactgtatcatttcgttggatattttcctcaaacctgttgagattgaactgaaacaaccatctcaatatgtacaaacagctctacacaactaaatctcattttctggcaactagccactgtatattacataactatgcttgcacttgtcataccttctattcatgtcctatgaagtatggataaacaaggagtattgctcacaagttgcgacatcaaaagcttgacaaaaagaatctagttgacgcacgggatgctgtctttgaccaatctaaaatatcctgcttcagtaagctcgtgcagtcactcttggctctggaatggatcacttgaacttacctcattctttgcaaacgttgttgttgttattgtcgccattgtaacaggttgactcgatggcaaaacaaagttgctccaaaaaagtggatccacggaaggatcagcagggctccaggtactcttcattggtgtaggcataacaggggccattgagtaagtagatctttgtactag

SEQ ID NO: 16959 - DNA, 584 bp, Zea mays
  Clone ID: LIB3279-200-Q1-N6-E9
cctatctcacttcatgttacaaactctttactctatagacagcagtctatagagatggcttagagggcaaaatcgaagctgtggtttgacccatatgccatcacagcctcacaggcaatacgctcagtgttcagatgctcgaaccacacagtacgatcatataacgcggtgttggtcatgtcatgtctccatatcacgcacactaccacaacagacaccatgttttagcaacatctattgaatatctcgctgaagcctattcacgagctggaggcctcaaaagtatctggcttatgcttctccatcagggccgtcagggctgcgtcgtgatccctctccagctccagctccttcttcatgtattgtttcttgagcttcatcttcttctcctcgtggcctttgatcagctcatcccgctcagcttcaaactctgccacattcttgacctggcaatcaatgaacttctgtacatgttccttccttagcttacgatcttcttcggtagttccagaatcaacatcaaagcgtctagcctttgagcgctcctcctgcagcaacttctcaaatcgtttttctttatcctc

SEQ ID NO: 16960 - DNA, 564 bp, Zea mays
  Clone ID: LIB3279-200-Q1-N6-F10
ccagagttcaaggcaaccacagacgttaagttaacatagcataatttcggcttggttcattcgctacaggatccactcatagtgggaacggagacttgtaactacaggaaagacccactgcaccacataccctttccatgccaagtagatccgtgtcttcagtctccaccaacctggcgtttccaggagtcctccacaatgagctcgtctactccccagacttaatagcttccatcaggtaagtaccgtgtgatcgtgaagggtatcttgcgcgctctcagctccttcattgcaatctcaagagggtcagtttcaccctgaagctcaaccatgactggagcattcatgcttatctgcaaggctcgtgtacccaggatgcgcgcacgttcgtacttcgtcatgtattttgccgttttgcgttcacgcttggtcttttcctgttccttatcttcaccctcaccacctatgacgtcatcaggggcatgtttgctgttctcaggctcttcttcagctccttcctcaatctgcggctctgggggctcatcctcataccccatgtcaatt

SEQ ID NO: 16961 - DNA, 518 bp, Zea mays
  Clone ID: LIB3279-200-Q1-N6-F11
gccaatccaacccaatttatgcacagacctgcagtaattttttttaacagaacacgcgtagtttctgacgtcattcaccacagcctacactggattagtgtaacgaaactgtactacctactggctacagctacagtaagacagcaggacacgcgttaaggcatcgcaatcccggcgagctaatttacaggcagaagagagcaccagctgacggcatcatgtcggcacaacctcgtcaaatggggccgagacccgcgccaagaacaccttcagggacaggcatagcattaccagctggacgaggccaaagagggacgctctgaaggtcctgctctgcattttcaggacctcggtcgtccggttgagctccttttcccggacctccagcttgtccacctgctttttcagcatcacgatcttgctctccgtctctcgtagcttgagcagcattctggtcttgtccccggcagacagcgccctgtgctcctccaaggccacctggtccaccggtcggacct

SEQ ID NO: 16962 - DNA, 585 bp, Zea mays
  Clone ID: LIB3279-200-Q1-N6-F12
ggaaaaaaacaccaaagaaaattcatataattcaagccatgattccactatccctttgcacattttgatattttgcagggaaaatggaactgtggaagggcatacacccaatagtgtagtctaaccaatgccatttcaactcatccataacaatggaaatgcattgggccaattacgccagcttacatcacacatttatctgattataatacatcataaatcccaatgcaattaaacagcaaaaatctactctcaggaagtcaggttttccttccagtgctgcactgcaccagcgagcatgcttgcctccttcggtggtctgatctggagcacaaaaatggtggagctgtacaaaaaaaaccacctatgcgcaacgtgcatcagccacaggtagctccgacattgtggcacgggccatactagcgctgtaaacaggatccctgcaaatacaatacatttacacgacgcctgcacaggcaggcagaccagcgaaggcccgtggtgcgtgctgccttgtctgcctgctgttccccgctggcatgatcaacgagcagcccgcgctccaacgcatcacttcggcgttag

SEQ ID NO: 16963 - DNA, 623 bp, Zea mays
  unsure (1)..(623): unsure at all n locations; Clone ID: LIB3279-200-Q1-N6-F2
aataaatactattatttttaataaatcatttctacatacccnttggtaaagacagttgctatagcctatgaagtgaatctgccgcctctataaatagtttctgtagtagttgcttcttttttctgtcgttacattactcacggaaacatcagctcaccaataggtcctgcgatcagggccaaacaacttgcttcttgtttttttccttctatttgtttcttgatagcacttgccaaatatattgtttagttaccctattttctttctcgagcatacaacatacattgggtcagttcgtcctggattaggagatatatcaagtgcctggggaggttcaaaacctccaacataatggaagtaagcaccaactatccatgcatgatcagcatcaccagttgaggtccatatagatatagcttttgtccaaaagcagcggtttgaaaagctcattatggcaaggccgcttggcttgagtattcgtcgcatctccttaaacacatctattggttttgtaaggtaatctacactaaccacattggtgataacatcaaaagtgttatcttcgaaaggaagctttgggttcacattgangtcttgcacgacatactgagtcagtaccgaat

SEQ ID NO: 16964 - DNA, 438 bp, Zea mays
  Clone ID: LIB3279-200-Q1-N6-F3
atcgataataacatggaacattttatttatgttatacctccaaaccaaacagccactgtctaccttgagcatttgaactctgtagtctataccatatagttcttccaaaaaatgaatgttaggaccatttcccttttgccaattttcaccatatgtttagctccacctaaccaagggaacatatttacttttacacttgggagggtatcacacatacacctacaggtcaatggtgattccttggtgcatatcttttgttttataaactttggtatttcaaaactagaacacatttaagttaaacatggatgataacacatcatcgagacgtcaattattaaagagtttattggttaattgacatggaaaacgaaatactatgaatgctcatctggagccaagtgtgtgtcgtgtagtgcctggaactcctggacctgc

SEQ ID NO: 16965 - DNA, 626 bp, Zea mays
  unsure (1)..(626): unsure at all n locations; Clone ID: LIB3279-200-Q1-N6-F4
gcgatctaggttctagatcgcgagcggcgcccttttttttttttttttttaaaaaaaacaatatacaagtttattagatacacataattaaactcacggataatctctcctcttctactgtactactacactttccactagctttggcccataaactccagtaggttgcaataccggatggagatacccaaagcgtttctcccttcgacttccacacaacacaacagaaccgcccaaaaagtgcaaacaggctgtgagtacctctcagtacaactatatgtacacctacagcaagataatcactgaactaacagacgtgctctctgcttggagcccttcttgctcgctggcctgacgatattcaggtagagagccgtagggctaccagttcagatgcctggctagcgacctggttcagtaagcgcggcagcagacagtttgctgaacctagtcctgtctcgttttggtgcgcaccgcgctggctcatgctttcttgaagaatgacataatgctcccttgcttggttccagccttcgcgggtttcttgttgcctgctgccgttttgcttggagctttgattntgtcggtgcttgttgctggcttcggnttgcttgggatagtcgccc

SEQ ID NO: 16966 - DNA, 444 bp, Zea mays
  Clone ID: LIB3279-200-Q1-N6-F6
ggacgacatcgataatgtcaatttaactccatccaaaaacagattcgaagtacacagtagcaggaattttttttgaagaaaccattacacacaagttcccccttttttctttaaacacgcctacagaatttattgggtccagcctcacctcacagttaaatacattacaacaggatctaaaggactaccattatcctaccggttttttaacctccggtgtcaaaactcgaatccaggacaaaaatcaagccgcaaaagcccccttaacacaagctttacaaccgaccaccaaaattcgacgctgacaaagggaaaaagagcaaaggcagaaattacgcaccaagcactacttgtcagagcctagctactatccccctacaaaggaatttcacctaactaggaatctcgtgtgcttgaatgtcctcaagaccctcttcgtaatga

SEQ ID NO: 16967 - DNA, 604 bp, Zea mays
  Clone ID: LIB3279-200-Q1-N6-F7
atcaatcaatttatagcaatcaaatcgacgaacatataataatagtaatacaatagccccttcgggcaatggcaatggcggtctcccagctgccttgatttgcgctaatatggaacgaatcatgatgacacaaatacattgtgaagctccatcagaaaagcgagttatatgtcaggaaggtgcaggcaatggacgcaacacatatcaccagggatggtagcagggtgacgttgagaagcttccccacgcccaggtaccccgccgcagtgatggtgcagtcagcgaccaccctcgccagggtcccggcctccgtcgagaggaggccaccgttgtatgtgccacgggagaggcgagatgacatcacgcttgataggagggaaaggttcacaccttcaagaacttctgcagaaacaaatgtgacaagtgctgagacaacatactggacaacagagtatgtactcgtaaccttgaagctgaagataatgcctactagcaacgtaatttgcgagaccatgagcagttgcctgtcctcaaacatattgctgatgtatgttccaacaacagcattaacaggaagcaccgtcaacccaaggattgctagaaa

SEQ ID NO: 16968 - DNA, 526 bp, Zea mays
  Clone ID: LIB3279-200-Q1-N6-F8
agaagactcaagtcttcacagatagatagatagatggataacactggtaaccagttacataaacaggtacatggtacataaaccagttacatagatagatagatggatatcatcattatggccctttattttccctctactttaatatatgggtgcgcagtcctcctgcgctctttcgaaaaaaaaaaaaaagttacataaacaggtacatggttcacagatccccaatggatcgaatgatatacttctaatgaggaaatggcacaaagctcatctgacaaatagctgtttggcaacactattaagagacttttaagaggcggcagcctcctcctggagctgcttcaccttggtgatgtagtcattcatcgcctcatccttcgatttgccttcaacagccttccaggcatcccacttggccctgtccttttggtagaatatgcccggacgatcggtattcacatctccaaccgtggcttgcttgtagagcccgtagaggatcagcttgttctcattgctcgtgctc

SEQ ID NO: 16969 - DNA, 79 bp, Zea mays
  unsure (1)..(79): unsure at all n locations; Clone ID: LIB3279-200-Q1-N6-G1
tttttttttttttttttttttttttttttttttttttttttttttttttttnttttttttggttttttttttttttttt

SEQ ID NO: 16970 - DNA, 550 bp, Zea mays
  Clone ID: LIB3279-200-Q1-N6-G10
agcatctggaatcaacaacatcacttagcatattccaagtttccaacaaatgtaacaaaacgaaccgcactgcatgcagctgggcatggcgagcgcgctggagacgctgtgcgggcagtcgtacggggcgaagcagtaccacatgctgggcatctacctgcagcggtcgtggatcatcctgtcggcgtgcgccgtggtgcagctccccgtgtacctgttcacggagccgctgctggtggcgctggggcaggacgccgacatctcagcggtggcggggaccgtggcgctctggtacatccccgtgctcttcttcttcgtctgggccttaccgctgcagatgtacctgcaggcgcagatcaagaacatgatcatcacgtaccttggcatgctcaacctcggcctacaactaaccctgtgctggctcgagggcgtccacctacgccttggactggacggggtcatgggatccatggtcgtagacatgtggatccccgtgttcggacagataggcttcgtcttcttcggcggatgccctctcacctggaccgga

SEQ ID NO: 16971 - DNA, 550 bp, Zea mays
  Clone ID: LIB3279-200-Q1-N6-G11
gcagaatcagaacgagaaacagaacatggggaacattagtacacaacgagctctgattgctgaagatcttctcgatgaagacgaacatacaataagacacaagggcgaaactagagcaggacacatcccatccacagatctagacacgagcatgctacagcacacagggcaaatgaagtccctactttctaagccttcttgggggacttggcgcccttcttgggggacttgggctccttgctgccggcgctggccgccttttccgccgcctttttgggcaggagcacggagtggatgttggggaggacccccccgtgcgcgatggtgacccctgccagcagcttcccgagctcctcgtcgttgcggatcgccaggagcacgtggcgcgggatgatgcgcgtcttcttgttgtctttcgccgcgttccctgccaactccagaacctcggcggcgaggtactccaggacggcggcgaggtagacgggggcgccagtgcccacgcgctgcgcgtaccggcccttctttaggtagcgcccgatccggccgacgg

SEQ ID NO: 16972 - DNA, 473 bp, Zea mays
  Clone ID: LIB3279-200-Q1-N6-G12
ggtctaatgctttttattaactttccttattgatactttgggccaaaaaagggtgtcaaaatgttttaagctgagtagaatgggcacacaactgcacatatatgatgcatcatcagatttggatctgttgcagattctgtgccactaccatcatgacaggaatgcataagcaccctagttctttgggcaccaaatatagttaaacaccctagttcttctttgggtattctcttgcaccaaatatggttgacccaactcttacatttgtgcttcccatttcaatcgcttgttcaaaatcagccgacatgcccatagacaattcgcactgctcttcgggtattccaagctccttgcacacctcttcccggcagttagccagcgccttgaaattctcaggggttgaggagtaatcaagcatcccaattgtcatcagaccagagaacacaaggttcgggcagttcagtttgacatgc

SEQ ID NO: 16973 - DNA, 614 bp, Zea mays
  Clone ID: LIB3279-200-Q1-N6-G2
gctgcaggatgatgtaataattgagttgtaaggctgtatgcatgtaaatgcaaaaggtcggaacgatgtttccatttccaaaaacgagcaaaagcacaggctgacatgcacaacaacgactaccaaacagatcaagcttcgcttgccggttccccgtcgctggccttctgtccttctggttccccgtcgccgctggctttctggcgtttgttcgagggttcgtcctccagctcctcgggttctggggctgtattgctactatctggcgcggcaccgctcccttctctgtggcagtcaccgccgccgccgccgttcacggcagcgttgatggcatcagggcccaacagagagacgtgtttgctcgtgatcttccggcctgctctgaccttcgggccccagtgccgctctgggtttggaaggaatcgtttcgtcttctttgccccagatttgccgagggcagcaactgctctggaaaagtctgcttctagctttggcgattttgaaaggatcaccgtgccaggtgagtcacgtgcctgttccttgataggatggttcttcacccagcagcgcatgatgtcccaaataacatcccaaggggcgtcagatttacccca

SEQ ID NO: 16974 - DNA, 592 bp, Zea mays
  Clone ID: LIB3279-200-Q1-N6-G3
atgctaagtaacatggatatcatttttgcatgcacggtttttcaagtttcgagtgacctgcagttcaaatctgaatttttcgaagaaattcaaataaacgaactaaatctactaacgattgaaaactctgttataattgtccacaaatgatacatgtaggtctacatagtgtaggaacataccacaaaaagtttggtggacaaaatctaaaaaataaaaatatgatttgccgagtgtcgagagaagacactctcggtaaagagttctttgctgagtgtcgaccctcggccttcggcaaaggctgacggccgtcagctttaggacggccgctgacggccctttgccgagcgccacctttgccgagtgtttgacactcggcaaacatgtctttgccgagagtttgcctgtgtcgagtgtcttgcactcggtaaaccagctcgttaccgagagcaggatttcgccaagtgcgactctcggcaaagccacctttgccgagtgcccgacaaaaggcactcggcaaagcgtccggcactcggcaaagtcccggattccggtagtgacgcaccgccaccgccttgtgatggtgatgaca

SEQ ID NO: 16975 - DNA, 605 bp, Zea mays
  Clone ID: LIB3279-200-Q1-N6-G4
aaactaaaacactctgatagatagaacttgctaagcacataacacaccgcctgagacactttgggcacacacttagtttgtacagtacctaactgacaccaaccacaatcagagcttagacctaaagcaacccatctcatgcggaggccttccgtgccttcttggaggcaggggacttcacggtcttcggcttggccttggccttggcggcgggggacttcttcggcttcgccacgaccttcttctcgggcactttgcgcttggtcccagcagcagcggccttctttggcttggcagccgctgccttctttgacttggcggcggcggccttggccggcttgggggcggtggtcttggcagcggcggcctttgccggcttagccttggtcttgggggatgccttcttggcggcgtccgagagcttgtacgaagccttgaccttcacgagcttgcccttggctgcggacccacggagctggatggaaagcatcttcttgaagttggccggcagagacgcgccgtgcttgtcccccacatacttggcgatcgcttgcgagctggagccggtcctctccttgagcgccgtgatagcctccttgatcatc

SEQ ID NO: 16976 - DNA, 584 bp, Zea mays
  Clone ID: LIB3279-200-Q1-N6-G5
ggcagcaacagtgccttgcagtaactgtcattccaagaattccataacggtgaacccaaatctcagcgacgattcccagccagctctacccagctcgggaaatccatcagcatgcgtttaagcaaagcctagtcctggaggttgcatgcgcaacttatagacacgatccttctgacaaacatcgcacaagattcatgtatataaacgggcagtgtgtccctctttaccggaagtaaattgacacgagcgggatgtcgacgtcattgtcgtcgtcgtcctcacaggccacaacaacgtccaaatggcggcggtaggaaggcacctccaacttggccacctccctggccacatcaaccaccttcttgtccagccgctccttgtgtctcgggaacatggagttgtacagcatcgaggtcccgcatgatatgctgtacgcattcaagcccttctccttcagccactccaggagctccctcagcgtcatgttgccagttaccgtccagcggtcccacacggtccaggacatgtcttggtgcttgatggtcttgggtggcacaggctccgccatggagaagagggggatc

SEQ ID NO: 16977 - DNA, 600 bp, Zea mays
  Clone ID: LIB3279-200-Q1-N6-G6
agagtgaaaatgcatacataaacatgacgagccaattcctcagccaaaaaacattatccatgcaacatcatataggttcgagtaacggtaaacggtcatccacatagagcaaaattaaagctcgtcttgacaaacacagaaaacagcaacaccacccagagagggctaacttcataatggccacccgccaagagccggcaaatggcacgcagagcctacagcctccttcccctcctaccgccctttctgcgagtgctgtcagtggggaccggggtaacgtcctcaatgcgtccgattttcattccggaacgagcaagcgccctgagggcagactgggcaccaggtccaggggtcttggtcttgttgcctccggtggcgcgaagcttaatgtgcagtgcagtaatgccaagctccttgcagcgctgtgcgacgtcttgagcagcaagcatagcagcgtaaggtgacgactcgtcacggtcagccttcaccttcatgccaccggtgatccgaaccagagtttccctcccagacaaatcagtgatatgaatgaaggtgtcattgaaggatgcaaagatgtgagcgacaccaaagacatactct

SEQ ID NO: 16978 - DNA, 485 bp, Zea mays
  Clone ID: LIB3279-200-Q1-N6-G7
tttttttttttttttttttttttttttttttttttttttttttttttttttttttttttttttttttttttttttttttttttttttttttttttttgggcccaagggaatcccccctttaaaagggggcatggactttaaaacataaccttggggagaaaaagggccttgcctttttacaagacccccccttaagttccatttttaacaaaaccccaaggcctaaagggggaactgggctaaaaacaaaggaaacaaagccctgctttcctttctactccccaatttaaacctcaccactttttttggggcccttcctaaaataccccaggttcctaaagaacttggggcccctccccttgggggaggcctggcgggggcccttgggttttttaatgccctttttgggccccttaaacaactggttttgcccccggtggtttttcaacttggccattttttccggatccccaaacgatggctcc

SEQ ID NO: 16979 - DNA, 586 bp, Zea mays
  Clone ID: LIB3279-200-Q1-N6-G8
aagataaatgtatattgaaaaaaactggcaccactcaacaataaactcagaccaagatgtttataatagactcagctccgaacaacatttctgtaatagactagaagggataaactggcatcccagcacaaacttgacgagctgagccgctgccgttgcccaatctcagaaactgaactctagatcttgttgaaagccacaatgtcgcaactctggacgtactcattgatgggctcttgcgtaaggtggtcctcaattagagtgtcgatggacacaagatcgtcgacaattgtcaacatgatagtcatcttcttgatgccgtatccaacaggcacaagctttgatgctccccaagtcagaccctccatctggacactgcggacagcctcctccagcttcttcatatcagtctcatcgtcccatggtttgacatccataaggacggaggatttaccactttctttctttttagaagaggccttggcagcggcggcacgctcatcagctgccttcttgtcctcctcagtttcatcaccaaaaagatcaaggtcatcatcatcctcagcctcatccgcaggagcagctg

SEQ ID NO: 16980 - DNA, 584 bp, Zea mays
  Clone ID: LIB3279-200-Q1-N6-G9
cttaagacaatgcaaactggcccaactcccacggaccagtaatctgttttgcacacgaaaatcatcgttctgaaaccaaccaggttttaacagcagacagtagtttcactagaagtggacaccacatcactttcttatgtaggttaacataggacaggacgcatgactgacgggaagataacacggaatgaacaccctcaacacaaggaacgccccctggccaaaccagcactggttgctaagttcaggcctttcacttcttcagatgggggaagcactggtacacgtctgtcttgggatgcttggcctcggcgtgctccctgcacttcacttcagtcgtggtacacatgaatgtttgcatgcacactttgcactggatgctcatggccttcttgttggtctcgagctggctccccttggcccccttgttcttctccaagttgcgctcgcgggccatcttggacttctggccgttgccaccgcccatggtggatggatccggcgacgatcgacggcaggtacgcgcacctcgcccgggggccgggccgcgccgtttcgcgttaggtttgtgcggacgcgtgggc

SEQ ID NO: 16981 - DNA, 567 bp, Zea mays
  Clone ID: LIB3279-200-Q1-N6-H1
gactcccaaaaacctatttgccattatgtcttataatttgtgtcaatactcatgcaacatgtcatacaggacaggaaccgctttgacaaaaaccaacacattccctatcttccaaggttcttttcttctacctcatcaaataggtaaaacaatataattcattcatgctatattggaggcaaaacccaactcccgacaacacctgcgacttcatgcctaccaccagaggcggtgggagcaagagcccaaatgatccaaccggctgaccttgaagactgaccacttccatgcagcaccactggtgatgcagcacaaggactgaccctgctgactgggactgacatgacaaacacctgagaccagaccaatgggaccgaaccaaggttttggaggacgacgccactaccccaactctgactagccccaaccactaggccaaggcacaatggcacagccgccattccaaatgggcatcttcagccgaagttgaatccacctgatggaacagagggctggttcccaaagttgaagccattctggggattgtcgccagagggcatggcatca

SEQ ID NO: 16982 - DNA, 535 bp, Zea mays
  Clone ID: LIB3279-200-Q1-N6-H10
gaaagaaaaaagtcactccattagccacaatggtatacaaaaagccatgaacacaccacatctgttttgcacttgtgcgcactagaccacagggtttaacagtgacatgagctctgctacacacacacacgcacgcaggctttagctattctggatcaccttccgaggaaattctttgacaaaagggttgcacaggtcttgaaacattagttgcagagtgatcacatcacagtagttctcttccaggaaaaacaccgaagcacctgcaggcatttccgcaacaaatacacctgacctgatataacgaagctagtagaacttcgaacctatatagtggggaaacggccgccttttttcagtgcctggcagctggcacagcactacgctacggaagaagaagccgaggtccgtccgactgtccgaggcaggcagctcaagtggagtggagcgacgtggccagagaaggaaaggaaacggaacggaacctccaaaggaaagggacgtcctttttcacaggtcgaggaagccggtggtg

SEQ ID NO: 16983 - DNA, 585 bp, Zea mays
  Clone ID: LIB3279-200-Q1-N6-H11
agcagaaccaaatattcattcccagcagtcatctttcgtcttattattattattagtacaataggataggagtacatggtactatgaagtagtgaccacaacaacatatgtcatccaattcattcagcagctaccgcttcttcctcttctcgtcttgggatttctcctgtgcattcttcatcgcaacaaagtcggtgaagagagtcagcgcgtgcttgatgtagtccatgtccccacggtgcgccctctcgatgatctcctgggtgtcaaacaccatatatcccaggaaaaccaggaggccaaagaagagctcaaacatgaaggtcgcgctggtgtggccaaagattgaagtagcaaactgcagccagagaagaatggagaggccagatgaaagcagaccgccgaggtacaggtattccctgcgcttggcgatgatggcagcgccagagaagcatgcaaaagcaactgcggtcccgacgaacgcagtgacgagaatcctcgaatccaagtcaataacaaggtcgacgagcggaccaacggacgcgccttgaaggagcgcggcagacatgagcagcgccaagcggt

SEQ ID NO: 16984 - DNA, 531 bp, Zea mays
  Clone ID: LIB3279-200-Q1-N6-H12
atcaaaatcaactgaatgtattatcatatagaactacgacatcgaaaggttcgaaccaaaccatgcaatgcggtcgacagaaaacaaaggggctagtacttatactgcacagcctcttacatagaggcaattttaaaaacagaacaggggcaccggttcaactagaaagccctaaaaacataagtgcacaaagcatagcaaattatctacaaaatatgtcgtctgacttcgggcattcatactttggaataatcccgcacaagacgtctcagagtgatgcctcaacgcctactcccagccttgggcagtgggctgggctgctgattcccaaccagtaggagcgaccactggaggaacagtgccatccacaggaacaggggccacagtttgatcccagccatcaccggtaggaaccgaagctggtgcagcaccccaatcagcaccagtaggagcaacaggtggtgcagccacatcagaggtccactggtcaccaccccactgatcagctccttggtaatcagtgactgcagc

SEQ ID NO: 16985 - DNA, 414 bp, Zea mays
  Clone ID: LIB3279-200-Q1-N6-H3
aagcaaacggaaaagggggtcccttcaaaccctagacaaagcaccaacaaccgaaaaatgtaacacaaaaaagacgccttagactttggcgggagacccggaaacgcacaagtccctacaaggagaacacagagtcccgatccaggaattgggccacttaagcataaagatcccccacttgaaagaggctcgcgggggcccccatggaggcaccaaaaaacccccttgaaactgcggaaaagggacacacaaaaagctgacacaaaaggtgaatcaagaagggtttcttattaggcaggtaaaaaaagcccatcttgactgcccccaaaaactccaggaaccaaaattttgcaaaaccccaaacaggattcgggcaaccgaccgcaaaagaaaacaaccttttgagcacccata

SEQ ID NO: 16986 - DNA, 557 bp, Zea mays
  Clone ID: LIB3279-200-Q1-N6-H4
aaatgctcaaaacttaacattgttcacgtccactgccacttcaccgtaccaaattcctaggcaactttagcatcaaaactatgttttttgaagtacatagggagacccaacataacattcagaatcaacgaaatagagtggagatatccagagggcatcatatttatgcattttcggtcatagggtactcaaagaccacatctttcccacacagcctgcggtagaccgcagtgcaggtctccagcttgtattcagtgttgttcctctcctttgggtccaagaaaatcttgataatcttggaaccatccagacggtatctgacacgcttccccacaatctcagctgggtagacaacatcctccaagatgccatcgtgaacagcagtcagagtcctggtgcgagggcgcagaacagctgaacccttcttgggtggcctcacaatcctccgtgtagcaacaattaccacatccttgccgctgaatttcttctccagctccctgacgagtctgacatggatcttcctgaaggccttgcgcaggcggtatgggacgtgaatg

SEQ ID NO: 16987 - DNA, 435 bp, Zea mays
  Clone ID: LIB3279-200-Q1-N6-H5
gactgttgaaatcttgcaacaacacttccacaaaacacatcgaaacgataggatgtcacatcaaaaccgacatgtaacacatactcaggtgatccaacagcataatccagcacagttcagtccatcggttgctacaggtgcataatgacaaatacgatgatcacagatcagcgacgctcttatttcacgatgtctccgaatgttcaggctcgtctgctggggacggcaggagacggacctctcaggcacccccaagtccggcgatcgttttcagccctggagtccaatgatcccacaagcaacacggccaccggcgtttccagtgctcttgctgagctcgtgcccaccctttccaagatcatcaggatcagcgtgaacaacaacagctctgccaatgattgagtttggcccagtcagtgggatctggctgtcggt

SEQ ID NO: 16988 - DNA, 594 bp, Zea mays
  unsure (1)..(594): unsure at all n locations; Clone ID: LIB3279-200-Q1-N6-H6
aataaaaagtataggtagtgaaatatatantgggagaatatggcgtggagacagtcttatatacagacatggaaatgaacggtgtgaaataccgaaatatacagttctatgctcctacgttccaaacaaaacatacatattccgatagaggcaaagcatttcagcttgacagcaacctactattatagaattctaaatacctaaaccttcattttaaactttcacgctttccatccttgcctggaatcctagtcacaccaagtatgtctaagcggatgatgcgaaatcgctggaaagcccatcattctcaatggtgtgcaggtgagcctcttcgtgtatgatgtctgcttcaagagagagcttggcaactccttgcccagagccttcatcagaagcaacagaaggctcgggttcagattcagagtctccagcaaggcgaaactcgacaacggacttgaaatcctcccacggcttcacccagacttttgctctgtacagactcttttttccagcatcagctgcctccagtatcaggtcatgcagggtcccggtcacaacctgccgcttcgatttgagcaccctagtgaactccaa

SEQ ID NO: 16989 - DNA, 584 bp, Zea mays
  unsure (1)..(584): unsure at all n locations; Clone ID: LIB3279-200-Q1-N6-H7
gaagtccaagtgaagttttcaatactgtaaaaatactacggttgtagccttgtaggtacaccatagtattcgaaacagcgttttacccgatacaaacaaacagattttgactttctataccatagtatcatccaataccatagcattccttcaaaaccgtaaaaatactaagattccaaacagggcctaacagttctagaacgacagacggccaccagcaacttcttatcatcatgcttcgggatggaacatcagttcagctcgccgtcacatcggcagctcgccgctatctgctatcacaaccttgctcttcggctctccactctgccggccttcagcttcgaccttgtacacaacatccattccagacaacaccttgccaaacaccacatgcttcccgtccaaccaacttgttgtcactgtggtgatgaaaaactgggatccgtttgtatctctcccggcattggccatggacagaaggcctggaccagtgtgcttgatcttgaagttctcatccgcaaacttcaagccgtagatagattcaccacccctcccgtccccgagagtgaagtcacctncttgga

SEQ ID NO: 16990 - DNA, 496 bp, Zea mays
  Clone ID: LIB3279-200-Q1-N6-H8
attccaacataacaggttcgtttaaatatttatgatcaagagacaaaagtctgctccaacagcataggataacaaaatgttttaatcccaggaagtttagcttcaagctgtggagacaaaagtttcacggtttcttattaatgagatagcatcaccgaaagaaaatccacgaataaccccagaagcagcttaggcagacacaccaccacgggggcactcgttcagcatgtttaggtagaactggcacttgctgatctcgctgccatagttgttgagacaatcttggaaagccttaaaatggatgctgcaagcgtcagcattcatcactggaggggcaggggcagcagcagcagcttctgaggcaacagtctcatgctgaatggtccggggacctaatacagcatcaacagccctgtgtgccatggcactacccgtgccaaacgccataccttgagcaatggtggacccaattcctccaaacatggagccaccacca

SEQ ID NO: 16991 - DNA, 500 bp, Zea mays
  Clone ID: LIB3279-200-Q1-N6-H9
aattggaaaccaaatccagacaaaatgaattaacagccaagggttgctatgattttacaaaagatgacttgctggattagcccacgtatttgggcgatacaaggtactcatgagaactaacaaaaaataccctcatccaggcatgcagggggttttccccgtaactaaaagaaacatcgaaacatttccagatatgtttctagtaatgtaagaaccgtttattactccacaaaactggtttgatggtagtacattatgacaatcttgttcctaaattcccaacttgcctagacttgttcacaaatccccagtttagccacttctatcagagcttcccatttgtgccaaaatctcggagatgtcatggcactgctaactgcctctgtttcctgcatccttatgctggtaagtaagattctaacatcagttgtgtttttgcatgtggtggtgacacgatatcaacaacaaggtatgtgaacttccacgtccgatcagtgtct

SEQ ID NO: 16992 - DNA, 628 bp, Zea mays
  unsure (1)..(628): unsure at all n locations; Clone ID: LIB3279-215-Q6-K1-A1
atctttccgtcatttattatgaggcagtgtgttgtatcgtttcactttcccttgctttatgtgccctctcatacaagttgcaatttcttcaattaaaccaccatcatttctccctgttattttgtatcctgttatagatctgccaatataatcagggtatcagctggtggttatgtagacgaattaccaggaatataaatatacatatgtttatttatagacactagagattggcaaaatgtttgttggaatgtggaattaaatcagcaatgtgccttcatctacatgccatatttctacatgctacctagaaacatatagctgtgttctgcatatcctatgtccctcgcgagccatttatttgatgtcttcctaattttcaggatgatgaagaatctttgttgcaaggagaacgtgaagccgaaatgatgatcgtggaggcctacgcagcacttgtgctcgcctttctttcaacggaaagtatgaaggttcgaggagccatttccagctgccttccggacaacaacttaaaagttcttgtaccagtgctagagaagtttgtgtcatttcacctgcagctcaacatgatgacaagnggaaacacattcagctgtcaccgaaatcattg

SEQ ID NO: 16993 - DNA, 644 bp, Zea mays
  unsure (1)..(644): unsure at all n locations; Clone ID: LIB3279-215-Q6-K1-A2
cctgcatccgccatcggnaaacagtgcgccgcctgcaaggccgttgctgcggagctagagattggaatttcgagtgagaagccgagaaacacttggacttgcgcaaccgcttaaattctaaaggccagagggaggggaaggtcattgattatagggtcagtgagcttcgggttgtggaacttctggatggcctatgcgataagatgcaagattataccttaaagaagttggaatcaggcgaaaagggatgggttaaagtaacagactggaatagctttcaaactgaaaataaggcagcagcaagagctcactccaaaaaattgtccaccttctgtggaaggctactggaggaaacggaggatgagctctctgagtggatcaaaacaacctccacagaatcagaatatgtaagcaaggccctttgtgaagatattagcaaacactgccgatctacaagtgctaccatccagattgatgatgagctatgacatgccgggggcaggtcgttgtttcgcaaaaagcaaaacaggcgtcaggttggaaaatgttaaagaacacagctctagtagtccctgacaccatttagagagacatgcagctgccaattctgattgtttgtgttgcactcgtatttcctgtaaaca

SEQ ID NO: 16994 - DNA, 642 bp, Zea mays
  unsure (1)..(642): unsure at all n locations; Clone ID: LIB3279-215-Q6-K1-A3
tctttcatggtggggtcaaatgaggaaatgttgttaagttgaggttcactcttcaaccacgccaaaggctgtatcacctatgaaagctccaccccctcctccaaaacgagatgttgctcagattgaaaaagtcttagcagtgcntgaaaaggatgcccagcagcgtcctagggaatcatctccacgaaggaagccagcttcaccaccgcggaaacgatctccaaatcgaagggctgaatcgcccaggcgtccacctgacccatcacctaggcgtcgtcctgattctccgcctattcgtcgccgaccagatccttctcctgtcaggcgtggtggcacacctcctcgcaggagaccactgtctccagttagaaggcgttctccttcaccacctaggaggcataggtcaccgatgcgtccttcacctaggaggggacgtggcagtccttcaccacgcaggcgctcccctgggcctcttaggcggcgctcgccacctccaaggcgtttgaggagcccaccaagaaggccaccacctccacgtcgctatagtcgatctcctcctcgccgaccccttcgctccagatcgatttctccaagaaggggacgagggcctctcttgaggcgtggtangtcaggctcatcata

SEQ ID NO: 16995 - DNA, 308 bp, Zea mays
  unsure (1)..(308): unsure at all n locations; Clone ID: LIB3279-215-Q6-K1-A4
atttgataaggtcgtgtgggatgtcgtggagcacaaagaggcgaatgcccttcaataacttttcagtatcacagcaaggacgggngaagaaggctatccaggcgatgtaaccattcgagcaacatactctcttcctgaagctactactctaaggcttgacatggaagctacaccagagaacaaagcaactcctataagcctggcgcagcacacctactggaacctcgcaggtcacgcctgcggcgacatcttaaaccactcgctgcagatctggggcaagcacatcactccggtcgacgagaacacaa

SEQ ID NO: 16996 - DNA, 371 bp, Zea mays
  Clone ID: LIB3279-215-Q6-K1-A5
cggggaatgctgtttctcaaagtagacagatagtgggcgatgacgacgatgacagtgatagctcagatgacggtgatgacacatcgatggctgatgaagaggctgggccagaagagatggcagtggacaggccaaggccccccaagcctactccagacgccgatgggtggactgttgtgcctcctaggcgtggtggtcgcagcaagaaatagctacctgccggcattctcgcggaatggtttcatattcacttgtatcgctcgatatttgacccgacatggatatgttgagtgtgtagtatgatgcttggtttgccaccgcccaccaatttggtgtaaacaaggtaattattatatatgcatcctttgatc

SEQ ID NO: 16997 - DNA, 593 bp, Zea mays
  unsure (1)..(593): unsure at all n locations; Clone ID: LIB3279-215-Q6-K1-A6
cacattacagctagctgcaaaatcgttcatgaattataagcatcaggcagacttaaaaacatggtagtcttagaacattgttctatatccttgcangagcaactagaaaaaactctcaacacagcacattcagaggatttatgcgttggcagcagcctgggcagcggcatcccgcttcctttgctcttctatgatgctcagcttgattcccttgcccttgggcaggctcacccacggcttattacccttgccgatggtgaacacgttgcccatacgggtggcgaactggtggcccagggagtcctccacgtgaatggtctcaaagctgcccttgtgcttctccctgttcttgataacacccacacggccagtgttccttccgccagtcaccatgacaacgttgccaacatcaaacttgatgaagtccacaattttgttggtctccagatcgatcttgatggtgtcgttggccttgatgagcgggtcagggtagcggatggtgcggccgtcatacgtgttcaggtacgggatgcccttctgcccaaactgaacagacctaccctgctggggtcatggatgttcttttccctccc

SEQ ID NO: 16998 - DNA, 636 bp, Zea mays
  Clone ID: LIB3279-215-Q6-K1-B2
cttgcagttactggaaaagattatgagtctgacccccgcatgccaggcgaggatgagttcgaccatttctaccgtgttctcgccaagaagactgacaacctgctcagctgctacattccaatgccgcttgcactttctgaagaggagaaggccgtgcagaaggagttcaagctgatcgcgagcggatgcatcgacctcctggttggtgcgatgcgccgcacccccgcagagaaaaggcgcccactgttcttggtgtttggtgagctgtacccggtatttgagtttgtgaggtggactgccgaggcggggtgtgccaagtggtggatggcgctgcagatcatcgagaagctggagatcgtgcgcaagatggtgtcgagcgctttcggcggcgcccctgttgacagaagcatggtgttcgccaggaaggtggacctcaccggtgtcgacggcgaggcgctcgccggccacggcctcgggagcaacttatcagtggtgatcttcgtgctgatggacagcgtcttcagcaacgtcaagtcggacatcgatgccatggtctctgctgcttccactccttattagccatcgtcacctagctacctacgtgtctacacgatcgagatttgcagtcactagcct

SEQ ID NO: 16999 - DNA, 618 bp, Zea mays
  unsure (1)..(618): unsure at all n locations; Clone ID: LIB3279-215-Q6-K1-B3
agnaacctgtactcttaagtagatgcacggccagnatatgtttccgtttgaacagaagcactgggcctgtgtggaacagctagattatgttgttgtatttcgcttgtaaaggatctaaagctcttagctaatgtacatgtgccctgctggtagctttgatatttggatggcttgcccagtaagtcagatatatgaaatggtatttgatttcttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccccccctcccgttttttttaaaaccctttttttaaaaaaaatcaaaaaaaaggccaaaattttaaaaaaaaccccgcccccaaacgctaaaattttaaaaaaaaatttggaaaaaagaaccaaaaaatttttttacacccatttggggaaaactaaaaaattccaaaaagggaaaaatttttcaaaaattgaccttgggaaaataaaaaaaaaaaacggggttttttttttttttccaacaaaaaaaaaagacctcccaaaattttttttt

SEQ ID NO: 17000 - DNA, 111 bp, Zea mays
  Clone ID: LIB3279-215-Q6-K1-B4
atcccttcctctcctgctgcctttctcttcttctcggtgaacgtgtgttcatttcactgttttggtttcatctcccgctctttctttaccccgtgctccggccaagtgctg

SEQ ID NO: 17001 - DNA, 626 bp, Zea mays
  Clone ID: LIB3279-215-Q6-K1-B5
acaaaaagggctaaataaaaactttcggtctcatctccgtccacatccgtcctccagcactccagctgcatcgacgaggaccgccgtagcgatttgcgaagcaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatctgtgccgcgaaggcgagaggcttaggcagcaggacagagccacgatgggccgaagctaagcgttagcttctttggtatctcaagggagcaatagcccttggaaatttcacaagattcctgcgtccctaccagaacaagtccctatctaggatggaatccatccttctgcaggctttcactttcctgataataacagtaacaataaattgacaatggtttgtgttcttctgcaacctttttggctccctggtttcgcaagggttccgtgctttgtttgaagtcatcacttgcatgcgttggtataaaaaggttgctgttgcatttggcgtacgggactaaaaaaaaactgggtcctgtctttgacacgtagccg

SEQ ID NO: 17002 - DNA, 641 bp, Zea mays
  unsure (1)..(641): unsure at all n locations; Clone ID: LIB3279-215-Q6-K1-B6
gcctccgccgccgccaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgncgcgtcgcccaagccccgcgggcgccctcccaaggtcgc

SEQ ID NO: 17003 - DNA, 631 bp, Zea mays
  unsure (1)..(631): unsure at all n locations; Clone ID: LIB3279-215-Q6-K1-C1
caaaggntaagaagccacagagacttacccttngagtgtaatcaatggtgtaatgttgttagatgggagtttagcaatcctactccattcataaggagccgtgaatttctgtggcaagaggggcatactgcttttgcgaataaagaagaggcagatgaagaggttctccaaatactggaattgtacagaaggatatatgaagaatttttagcagttccagtgtccaaagggaggaaaagtgagatggaaaaatttgcaggtggactttataccaccagtgttgaggccttcattccaaacactggtcgtggcatccaaggcgcaacttcacactgtcttggtcaaaatttcgccaagatgtttgatatcacttttgagaatgagaagggtgttagggaaatggtttggcaaaactcttgggcctacacaacccgctcgattggagtgatggtgatgacacatggtgatgacaaaggcttagtattaccgccaaaggtggcaccaatccaggtaatcgtgattgcagtgccttataaggacgctgacacaactgccataaagggagcctgcgaatcaactgtttacacactcaatcaatctgggattcgagcggatcaggacacccgtgaaa

SEQ ID NO: 17004 - DNA, 635 bp, Zea mays
  Clone ID: LIB3279-215-Q6-K1-C2
cccagcgtccgcggccgcgtggggatttagtgttccagtttcccaccgaataactgccggctgcgatatattgttaatgccatccagattcgaaccttgtggtctcaatcagctatatgctatgcagtatggcacagttcctgttgtccatgcaactgggggccttagagataccgtggagaacttcaaccctttcggtgagaatggagagcagggtacagggtgggcattcgcacccctaaccacagaaaacatgttgtggacattgcgaactgcaatatctacatacagggaacacaagtcctcctgggaagggctaatgaagcgaggcatgtcaaaagacttcacgtgggaccatgccgctgaacaatacgaacaaatcttccagtgggccttcatcgatcgaccctatgtcatgtaaaaaaaggaccaaagtggtggttccttgaagatcatcagttcatcatcctatagtaagctaaatgatgaaagaaaacccctgtacattacatggaaggcagaccggctattggctccattgctccaacgtctgctttggctggcttgcctcgatgcaccggatgcagtgaggaatccagtcgaacgacagttttgaaggataggaaggggagctg

SEQ ID NO: 17005 - DNA, 363 bp, Zea mays
  Clone ID: LIB3279-215-Q6-K1-C3
ccccgcgtccggcaacgcccagaggaacccgtcgccggcgcctcccgccagcctcaccaccgctcccggcagcctattctcgcagtcgcagcacacggcgaccgccgcggcgaacgacgcgaagaacaacaacaacaacaacaagcgttcgatggaagccacctccctggcgagcaacaccaaccaccacccggcggcggcggcgaacgagggcatgctgtccttctcgtcggcgccgaccgcgcggccgtcggcaggcacgggcgcgccggccaagtcggagtccgaccactcggacctggacgcgtccgtgcgcgaggtggagagcagccgcgtcgtggcgccgccgccggaggcggagaa

SEQ ID NO: 17006 - DNA, 61 bp, Zea mays
  Clone ID: LIB3279-215-Q6-K1-C4
gctctcaccacctcctccgcgtctgatcggcatcgccttcgcctccgctaaatactcgcgg

SEQ ID NO: 17007 - DNA, 640 bp, Zea mays
  Clone ID: LIB3279-215-Q6-K1-C5
cacacgcagccacgcttccgcggcgccaccaccttccgccctccgctgcccgctcgcctccgcgcccgaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttgggcggattggcaggttggtcctgcgaattgcaaccagcagagatgatattgaagttgtggctgtgaatgaccctttcattgatgctaagtacatggcctatatgttcaagtatgattccactcatggcccgtttaaaggttctattcgtgtcgtggatgattcaaccctcgagatcaatgggaagaaagtcacaattacaagcaaaagagacctgc

SEQ ID NO: 17008 - DNA, 264 bp, Zea mays
  Clone ID: LIB3279-215-Q6-K1-C6
cggccgcgtgggctgcaatccggctgcggctgcggcttctacagtatttttctctctatggattgcagctgcagcagtccaaacagctgcaacagtgtcggcttgcagccagccgaacacgtatatatctactgggggcttgctcccatgatgcgattttattccaatctgacgtcagatgctttacgagcatatttaactgcttgagctgtacgtagcttgtattacttgtaactttgtgtaatatggttattattaccgaag

SEQ ID NO: 17009 - DNA, 325 bp, Zea mays
  Clone ID: LIB3279-215-Q6-K1-D1
tttgccgagcagtgacttttgttaatgcgggcgattaacctgagattgaacagaggatcgactcagcgaccaaaagcgcacggtttaaaaaggatggagacttatagacagatcgacagacttaccacaaaccgacagactggacctatcgaccaacataccggatccacaaactaccggactgtcgcccaaccagcctggcaaattgttgattctgctctgactggactgtgactgcctgcctgccctcctggacacactcactgtcctgttgcactacatactgccgtcatttaattacaatgttctgtgcgtatccaccagc

SEQ ID NO: 17010 - DNA, 475 bp, Zea mays
  Clone ID: LIB3279-215-Q6-K1-D2
cctaccccggatttccctctcgttaagtgcccgtcgctcctgccgtaacgccgacgtctgtgctgagaagcgagatatggacacccaagtgaagcttgctgttgtggtgaatgtgatgggaaggaccggctccaggggtcatgttacccaggtcagagtgaagttcttggatgaccagaaccgtctcatcatgaggaacgtcaagggaccggttcgcgagggagacatcctcacactgctcgagtttgagagggaggctaggaggctgcgttgaggcgggatactgtcttggtagttttcgtatggagttggatgtcatctaattgtgctatgtttgtcaaactttgttatgacctttaaaacacctgccttgtatgattatttgtgagcctggtggtaagattgcagtttggtttttatgatccggttgaaggtatgtttggcattgcttctaagatgttaacagctctgacgt

SEQ ID NO: 17011 - DNA, 617 bp, Zea mays
  Clone ID: LIB3279-215-Q6-K1-D3
cctcgcagccgtattcctgtctcgaatcctctctcgccgctccgatggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccgtcgcgctccgcgagatccgcaagtaccagaagagcactgagctgctcatccgcaagctccccttccagcgcctcgtccgcgagatcgcgcaggacttcaagactgatctgaggttccagtcctccgccgtcgcggcgctgcaggaggccgccgaggcgtacctggtgggtctcttcgaggacaccaacctttgcgccatccacgccaagcgcgtgactatcatgcccaaggacatccagctcgcgcggcgcatcaggggcgagagggcttgagcgcccgtcgtgctgctcgtcgttgtagtgttactagaagtagatggtggctttcgtttcgtggcttccttatcctgtaggagtaatgttctagatgtcttggcttcagtgcaatggactgtgtttgctcatttctgaaatttatcaatggacttgttcttg

SEQ ID NO: 17012 - DNA, 582 bp, Zea mays
  unsure (1)..(582): unsure at all n locations; Clone ID: LIB3279-215-Q6-K1-D4
cagnaaatgatcaacgaggttgatgctgatggcaatgggaccattgacttcccagagttcctgaacctgatggcaaggaagatgaaggacaccgactccgaggaggagcttaaggaggcctttcgcgtcttcgacaaggaccagaatggtttcatctcggctgctgagctccgccatgtcatgaccaacctcggcgagaagctgactgacgaggaggtcgacgagatgatccgtgaggccgatgttgacggcgacggccagatcaactacgaggagttcgtcaaggtcatgatggccaagtgaggagccgtccccgttatctatgaattgaagttaaatatcaggcacacaagctgtactttgccatgtcccttttgagtacacatcagtatcatgcaggaggtaatgtctagtagtggtcggtttaggtggtgtagtcatgggaactcgacatcagatacctggtctcttttgattgtgatgttatcttgcattattgctcctgctggagcttttaggatttgttgtaagctcatattttcaggggggtttggatcttttgtgcgagtcannnnanannna

SEQ ID NO: 17013 - DNA, 626 bp, Zea mays
  unsure (1)..(626): unsure at all n locations; Clone ID: LIB3279-215-Q6-K1-D5
gccgaccgccgaccgccgacgatgcctcccaaggccaanaaggacgctgcgccgtctgagcgccccatccttggacgcttctcctcccacctcaagatcgggatcgttgggttgccaaatgttggcaaatcaacttttttcaacatagtaacgaagttggctatcccagctgagaattttcctttctgtaccatcgaaccaaatgaagcacgggtgaatgttccagatgaacggtttgattggctttgcaaactttacaagccaaagagtgaggtgcctgcatatcttgaagtaactgacatagctgggcttattagaggtgcccatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagcagctcaaaattgagcatgaattatgtgagagggtcataggccatcttgaggaagggaaagatgtccgttt

SEQ ID NO: 17014 - DNA, 270 bp, Zea mays
  unsure (1)..(270): unsure at all n locations; Clone ID: LIB3279-215-Q6-K1-D6
cagnattattccggagtaaagggacaggaagacagttttcgtgtaatgtcgtctggcagctaaaaaacgggtctgatgaccctctaataccggattcgctcgccttacttaagaacttagaagaaatggttcagcatgatacaagttttattttattttttgtttcattttgcggattatttgccctgggctggagagtgggaattgaggggaacaaaatagatgctgttactcgcgatgtactccctgattcgttaaggaattcaccag

SEQ ID NO: 17015 - DNA, 630 bp, Zea mays
  unsure (1)..(630): unsure at all n locations; Clone ID: LIB3279-215-Q6-K1-E1
tttgtatttattatccttaaatcatatgagnaaagataattatatactatatttatgttataggcgcaagtagaagaatgtgctataagtagggatgtaatatggttcggaaaatatccgtccggatccggattcgaagatggtgaacactggttcggatggaattttcggatatccggactttttttcgataacggatacgaatacggatattttgttcggatatcgaattcgaatacaatatgcctgatatccgtcggatatcgaatatccggatattttctcggataaatcttcttggatatccggatgtcttatccggatagcagtgtgcatttgttgatttttgtagaaaaaaattaataatacacaaatagcctcagaaattcatgaaattttatggaggcataccatatgttcatatataatcctccaaaatatttggaccataaaatccaaaatatgatggtgtttctttcatttcactttcacttgtgtgaattacacatgaaatcattttaagtatccaagttcactttatcattttcatgtggagacttgaggttatattcttatagaatgtttattagttntggtaacttatttgcattttgatgattttatgcaaaa

SEQ ID NO: 17016 - DNA, 649 bp, Zea mays
  unsure (1)..(649): unsure at all n locations; Clone ID: LIB3279-215-Q6-K1-E2
cggccacgtggngctgaagctgctaaggttggagaaatgaatgttataaagatgctcctgatgggtaatgttgatgtcaatgaagccgactctgaaggaaacacagcacttcactggtgccttagtggtgcttcatgtaccaaggaaccaaggattgtgtggcttctgctcaagaatggcgcaagagttttccaggggaacaaattagggctcacaccagtacacagcgctgcagctaagggcaattacaaagctcttcagtcacttctgcttcatgcccaagattgtgttgatatacctaccaagaccaaagaaacgccattattttttgcagtgaagaatggttctgtggattgtgcaaaacttcttttgcgtttcggggctgataccaaagcccggaacctgagaaagcaaagacctattgatgtggcaacatcccaggacatgcgtttcatccttagctctgcaaatgtgttactattttcagggaaccataactcacctcaaaagaatcgtgtgatgagaaaggaaatttacaaagagcttggtgatgaatttgacgattttgacaaggattcctgtgatgaaagctacactgggcttaagacatcagtagggcaacgtgatttctgctccagtaatctttctg

SEQ ID NO: 17017 - DNA, 638 bp, Zea mays
  unsure (1)..(638): unsure at all n locations; Clone ID: LIB3279-215-Q6-K1-E3
cccagcgtccggcaatgctggngatacatttggagcgcctggaggcattatttgtgcgaaggcatccatgttactgcagagcgtcccaccggcagtactggtccgatttctgagggagcatagatctgaatgggctgattacaatattgatgcgtatttggcttcatcactgaagaccagtgcgtgctcacttcctgggttgcgacccatgagattttctggggggcagatgatcatgccacttgctcacacagtggagaacgaggagattcttgaagttgtccgccttgaaggacaacctcttactcatgatgaagcccttctttcaagggacatccaccttctccagctttgcactggaatagatgagaaatctgtgggttcctccttccagcttgtgtttgcaccaattgatgagcattttccggatgatgctccattgatttcctctggctttcgtgtcataccacttgatatgaaaacagatggtgtatcctctggtaggacgctagatttggcatctagtcttgatgtgggttctgctgcaccccaagcctcaggggatgcacctccagatgactgtaatttgagatctgtgctgacaatcgcctttcaattcccttatgagatgcaccttc

SEQ ID NO: 17018 - DNA, 530 bp, Zea mays
  Clone ID: LIB3279-215-Q6-K1-E4
cccacgcgtccgcccacgcgtacgcttgttcttctgccatcatctagcatgcggcttacctttgttcgagatgatgggtatccagagcaactagctctcttgagcaacgactttagaattttcggaagttatgattgaagaaatatcagctgataattctggacgctctttcctaatcagcaatctcagaatctaaagtgttttactactggtgtgctgagaagtctaaggaagattgaatggaacttcttgcacaggcttacacatacctgttttgacaagagccgagcaaccatgcttacatttcgggccaccacctatctaaaggctaatggatccaaatgtatgaagtaccgaagacagggttggctcctcgttttttgtgcatgtcaaaaaatcgtgtatgattgcgacaatattggcaaaatatctgtgtactttatattttgatttactgagaacaaaacaagtgccctatgagaccatcgtgatttatgcattttcaaactaaaaaaaaaaaaaaaaagtca

SEQ ID NO: 17019 - DNA, 603 bp, Zea mays
  unsure (1)..(603): unsure at all n locations; Clone ID: LIB3279-215-Q6-K1-E5
cggacgcgtgggcggncgcgtggggttttgtttcccttcccccacccttcctcttcctccctatctatcagcactgctcgccggcgccgcctctgcaaaaggctcacttttgcctccggaacccagcggaatccgccggcggaccggaaacactcgctcgcccccctcaccccctgtctgcccggccgtcggagcgcgtcgcctccgggcgtgcagcagcagtccgtggaggtggagccgggaggaggaggaggaggacgaggacgaggcataatctgccgagagcgggacagcaggagtgggctgctccgctcgcgctggagccaaagctactgattgccttgtcctgaccagcgaaagagggatctttgggaggcaatcagaggtgttcggtttggtcaaacaaagctcagctctcttgggatgcttgctgcgagctgcttgtgttcatacttgagagaataaaacagtgcatcatcttgctgtcttgtccttcgtgattggaagagaaaacgtgctgctgttcttgctatgtctgtctcggagaaggtggcgccatcgaagtcatcagtttcttcgtcgtcagatttggatccgctgctg

SEQ ID NO: 17020 - DNA, 613 bp, Zea mays
  Clone ID: LIB3279-215-Q6-K1-E6
ggcagcctggtttgggcacactgtaaaccggtcgggtgtagggctggacgaaatgcaagtgacttgttgactcacttgatttatggtcagttcggtttggctcagattagctcgtttaatttttttcacgagttgaggtaacatcctagctcgattcgttaacgagctagctcgattcattaacgagttagctcgcaagctaaacgagctaccacatttcagcaaaacgaaactatatgcatattatttacggaataattgatgaactatatgtatgtggggtgcttggcctatgagttaaactaatgattaatgaactatatctatatgtcggagaggaaattctccggccgggtggcggaatgcacccgtcctaaatcctaagatgaggaggggccttagcggtttgcttgtctgctagatggtggatgaaaacacgagagcacacgaaggtttagagtggttcaggccgccggggcgtaaaaccctacctccattgtatgttgtattgaatatgtctgagagtctgagagtccaagttgggtctgtgaattgagtctgccttgtaatattatgtgtcttcccttttatagcccaagtgaggcacatcccc

SEQ ID NO: 17021 - DNA, 631 bp, Zea mays
  unsure (1)..(631): unsure at all n locations; Clone ID: LIB3279-215-Q6-K1-F1
gcccaggccagncagtgcaatccggtcgagcctgatcaggtccagacgtctataaaagaaaatacgtagtgctagggatcagtttttcacgccccatctcgattcattagcgacggcggttgcccgatagcgcgcgcggcggtggactcccggccagtggctgcagtggccgtggctccccgacctcgatatgcggtggctcccgatccagagggcgagcgacggcagtgcccttgtgcggtggcggcggttccccggccggtggtcgcaactccattaccttgacacgcggtggcggaggttcctcgatccggagtagtggcggcggttccgaggtcggtggcggcggctccccgatccagagggcgagcgatggcgaggcccttgtgcgggcaagcgacggcgtctccgaagccctgaggaggcgacacttccaaggtcgacgagcaagcgacgcccgtcgatgtgcgagtagcgatggcgacgcatgaggcacgatgttcgagcgagcggcgtcacggaaggcgcgagatgcgcgcagcgatgatcgcgcgtgacatcctccgatccggcgcagttttcttttcgattattgtgttttatgtctaccacatgtattatttacgctaaa

SEQ ID NO: 17022 - DNA, 642 bp, Zea mays
  Clone ID: LIB3279-215-Q6-K1-F2
gtgtccggtttgcatttttctctggttactctacttgctcagatgctagggttatgtgggaccagaaaacagacgatccagagggtttggttttgtttctttcaggaaccagcaggatgctcaaagtgcgataaatgacttgaatgggaagtggcttgggaaccgtcaaattcgttgcaattgggcaacgaaaggtgctaatgctggtgaagagaaacagattctggacactaaggttgacctgtcaaatggttcatcagaatctggaaaagagaatccaaatgatgatggtcctgaaaataaccctcagtttactactgtttatgttggcaatcttcctcacgaggctaccatgaatgatgtgcacctgtttttccattcactgggggctggttcaattgaggaagtccgtgtaactcgtgataaaggctttggctttgtgaggtacagcacccatgaggaggctgcattggcaattcagatgggtaatggccaacttattggcgggaggcagataaagtgttcctggggaagcaagccgactccacaagggacagcatccttgcctctgcctcccccagcactggcaccattctccactggagtgtcggccaccgacttgctggcctaccagcgcctgac

SEQ ID NO: 17023 - DNA, 554 bp, Zea mays
  unsure (1)..(554): unsure at all n locations; Clone ID: LIB3279-215-Q6-K1-F3
tttcactatttcanacaagattaaaatggagggtgcagcatgggaggtgaatgctcatttggaaagtaagaggatggacgaggactacgattccgctgatcgggagtgcttttcatgcttctatgatctgcacttgtctgctgtgagttgccagtgcagacctaaccactttgcttgcttaaaccatacaaaccttctctgttcatgcggaatggacagaaaaaccgtcttgtttcgatatagcatggaggagcttgatactcttgtagcagctctggagggtgatccgactgcattttattggtggggacacaaccactagtgtgctcaactggctggttctttgatgcagcatagaaagattggactcatgtaaaagcacatacattttttttttcaggattagggtcagtgattaattgatgccaatcttgttgctagatttggtgggcgccattgcatgcatgaccttggtagcctagcaggattctgtcgcgattttagagaaataagtcacatgcttccaatatatttaaataaattaaatattctaa

SEQ ID NO: 17024 - DNA, 328 bp, Zea mays
  unsure (1)..(328): unsure at all n locations; Clone ID: LIB3279-215-Q6-K1-F4
ccccgcgtccggntcccgtcgctgcccaccgnaancggaggtcttgcagctaatagagaaggcttagatcatcatcgtcctgtacgccatggttttcaccagcttctacttcttcgaattgtattggattctgatatggaacagaagaagaagcggctgccccatcttaccagccctttttgtttgccctagtttccccttgtgaaagggtgttttgttttataaactctacttgcaataagcagagcctttttttaattatgtcagggtgcatttgatacgatcgaataatcatcaatccataattgtagcaatttttttttaaaaa

SEQ ID NO: 17025 - DNA, 630 bp, Zea mays
  unsure (1)..(630): unsure at all n locations; Clone ID: LIB3279-215-Q6-K1-F5
ggccgccctttttttttttttttttttttttttttttttttttttcgcgcaggacttctaagaagcagagttgcacataaataaatagtaccaacaagaatgtacacccaacgcataaagccataagctgaataacagcaagaagtatatttattcattaaaaacgctaacacaggcaggtataggaagaacaagctgcagcgtgcaaaaacgcaggcagcggatcgcagcgcctggcagcagcagcagcagcagcgaacgagctcaacttatctgatcaatccgtttcaattgatggaagggaaactaaactagtgttgcatcgagaacgaacatcaacaaagcagttttgacctttttgattacgaccaaccgacaacaggtcgactcggtaactcccttagcctcaactcgactcgaatgatgaacttgatagtaactcgaatgatgaacttgatagtaactcgaatgatgaacttgatagtaacagatacctttagagagggagagggggggggacgaaagggtcgatgcacggatctatctcttgngtcggcggcggcggcggggccccgcccaaaagcgtctgctgctgcagctcgaggtcgttgagctgctgctcccggtcca

SEQ ID NO: 17026 - DNA, 508 bp, Zea mays
  Clone ID: LIB3279-215-Q6-K1-F6
attgcagaatgtccaacaagtggtattttgtgggctgcagctattgagatggcaccacgcccacagcgtaaaggaaagagcacagatgctattaagcgaagtgatcatgatccacatgtcattgcaactgtggccaaacttttctggcttgacaggaaggttgataaggctaggagttggttaaacagggctgttactcttgctcctgatattggtgatttttgggcattgtactacaaatttgaacttcagcatggaaatgtggacacacaaaaggatgttctgaaaagatgtgttgcagcagaaccaaagcatggcgaaaaatggcaagcaataaccaaggctgttgaaaactcacacctgcctgttgaggctcttctgaagaaagctgttgtcgtgcttgatgtagaagaaaacgccaatccggcaggagcctagactcttttttataagttgtttggtgaacatattttgtggcttacaatttactccgcaagtctgcatcttt

SEQ ID NO: 17027 - DNA, 634 bp, Zea mays
  Clone ID: LIB3279-215-Q6-K1-G1
ggccgcagcccagcccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacgcggggattcccaagcggttcaaagaggatgaggagaaagaacagcttgcaaaagatgtcgcaaaagattggaatgctgtgtttgaaaggagcatcaatacattgtttttgactgaaatggtccgtggcttgatgctaactctcaagtacttctttgatagaaatgtcacaattaactatccgtttgagaagggtcctctgagcccccgcttccgtggtgagcatgctctcagacgttatgaatctggggaagagcgctgcattgcttgtaaactatgcgaagctatatgcccagcgcaggcaattacaattgaggctgaagaacgtgaagatggcagtcgccgaaccacaagatatgatattgacatgaccaaatgcatttactgtgggttctgtcaagaggcttgcccagtcgatg

SEQ ID NO: 17028 - DNA, 633 bp, Zea mays
  unsure (1)..(633): unsure at all n locations; Clone ID: LIB3279-215-Q6-K1-G3
ccccgcgtccgccccgcgtccgngacgacgcagcccaacccgttcccaccaaaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttgtttgagacgaaggaccaccactgagccctgattagcacaccttcaggagctggtgcacgcttaaaagagttatatggttgtttcagtgattttccttttcccttgagacctatttgctgcaacaagaaataagaatgaccaaactcttgtattgacagtgaggttttaactgtgttagctgttaccggcttgtctatttttctttgccgtccacgccatatatggtcacctttaagttggtgttgcccggtgtcaggaaacggcatcacaattatcaaaagctgttattgtattctgatggctt

SEQ ID NO: 17029 - DNA, 619 bp, Zea mays
  unsure (1)..(619): unsure at all n locations; Clone ID: LIB3279-215-Q6-K1-G5
gctgataanagggagtgtagtacgcaccgcccgggcttcttgttgtcctttcctcctcctcctcctcctcctcctccgccgccgcccttccccttcccacctccaccactgccgcccttgttgttgtccttccccttcgtcccctcctccccctcctggcgatcgcccttgtccttctccttgccctcctgctcgccgcctccgtgctctttgtccgactgcttgccgtcctcttcgtgcccgcccttgtgctggttcccgcctccctgcttgttgttgtttccgccgccgcccttgttgttgctgctgttcccaccgccgccgccgaggacgaggtcgaccttcttcttggtcttgtcggcgacgcggtcccgcagcttcttggcgtcgaggcggcccaccaccgtcatggtgcccttgtccacgtccatcgccacgccctccacgcctgtcaagccaacgaacgagcgcagccatcggccatcagttggcgtcaccagagcctcctgtctgtctgtgtctgctggacatcacaagatggcgcgccgccagagagacacatagacaggcaagggacatggggctttcattgcgttgcgttgcttgcctgngtagcggc

SEQ ID NO: 17030 - DNA, 306 bp, Zea mays
  Clone ID: LIB3279-215-Q6-K1-G6
cggctacacaaggccccgtggcgatcaaaaaaaagagcctatatccatgtactagaattattcagtttcactccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaagtaattattgtgttc

SEQ ID NO: 17031 - DNA, 592 bp, Zea mays
  unsure (1)..(592): unsure at all n locations; Clone ID: LIB3279-215-Q6-K1-H1
nganagttattagcgaggnacgcggtcttgatcttggcaaagttcaattacaaatgcttggcactgctaaaaagtaactgtatcccttgatgatactatcatcctagatggtggaggtgacaaacagcagatagatgagaggtgccaacagcttagagaatcaattgacacaagcactgctgtattcgacaaagaaaaggcccaagagcgtttatctaagttatctggaggtgttgctgtactcaagattggtggagctagtgaagctgaagttggtgagaaaaaaatagggtgacagatgctctaaatgctgcaagggctgctgtggaggagggcattgtgccaggtggtggagttgcccttctttatgccaccaaggagcttgacaagattagcacagcaaacgaggacgaaaagattggagttcaaattatcaagaattctttgaaggctcccttgatgaccatagctgcaaatgctggcattgatggagctatagtcatagggaagctgattgaacaagaggacctcagtttgggctatgatgcagcaaagggngagtacgtagacatgattaaggccggcatcatcg

SEQ ID NO: 17032 - DNA, 493 bp, Zea mays
  unsure (1)..(493): unsure at all n locations; Clone ID: LIB3279-215-Q6-K1-H2
ntatttggcagggtgagggggacggctgtgaagcacanatcctatgtttatgggtacactaacgcccaactgagttgagtgtgttttggttggttggttggtcgcgacaagtatggcaggcacatgggggagcgccgcattacccacacccaacctggggatttggccaagacaaaagcccagcggtatgaggatcgaggaagcagaccagagttgttgcggagcgagaggactggggatcagtgtgtgttgtgggttgctgggcaaggatacatgcagggggagctgatggttttgcaggggatgatgttgtgtagctggttggttggttggggtgtgtagaaggcattcattcccctttgtaacagcctaatctgtacattcttaccatcatctttgtcttgttgattgatcgagtcgcagacctcctgcgtttatttgcaaaaaaaaaaaaaggggcggggccgntcgcgatctanagntctagatcgcg

SEQ ID NO: 17033 - DNA, 644 bp, Zea mays
  unsure (1)..(644): unsure at all n locations; Clone ID: LIB3279-215-Q6-K1-H3
cgnaggcctcgtggcctcgtgcgctgccctcaacgnagccacctaccttagcctgagaccgaagtgcaggaagccacagctgacaaaaaacttgctcaaatatattatcaacttcaatatcttaatggatactaacttgcatccttatggccaaggtgtaaattgtaaaaaaagtaatgttcaatatagaggccaaaaatgcaagctcctgcgaggtgactctaacttgcatccttaggagtctaacctctaactttaaagtgagggttgtgcagcgtgttggtggatttcacatttcagagaggatagagaaagctccgcttcgcttttttgaatggcttccgggaggataagctggtgtagaaggttgtggtggaggtcctgcctttttggcttgcaagcgaagggcgcaataacgagcaaccaagcattttgtagcagccaatcctaaacgttgaaggacttgagcacagggaggtgagtgggtctgtgctgctggagggctatgtcctatgtgtagtccctcttatgtctgaaattagtagtctctctggcatttttgtttgttttccttcatgtaaaacagatagccatgttaaaacttcaacttgttttgttttacacagttgaaaataatggcatgt

SEQ ID NO: 17034 - DNA, 621 bp, Zea mays
  unsure (1)..(621): unsure at all n locations; Clone ID: LIB3279-215-Q6-K1-H4
cgcagtccacgggaggaagctcccagaagcgcttgccccaagctgcccgtaagtctgcccccaccactggtggagtgaagaagcctcaccgctaccgccctggaactgttgccctccgtgagatccgcaagtatcagaagagcactgagctgctgatcaggaagctgcccttccagaggctcgtcaggngaaattgcacaggacttcaaaactgatttgcgtttccagagccatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccg

SEQ ID NO: 17035 - DNA, 523 bp, Zea mays
  Clone ID: LIB3279-215-Q6-K1-H5
gcttaggttttgcacccctgtgtgttggaggagatatggaatcagtggcagttcaggagtttagcaggacactcttcaatatacgtccggacattgcactaaatgttgcccagacgatcttccagagcgatgtgcgcagcctcctcccgcacgttagtgtcccatgccacattgttcagagcaccaaggatctcgcggtgccagttgtggtgtctgagtacctgcacaggcaccttggtggcgactccatcgtggaggtgatgccctctgaaggccatcttccccagcttagctctccagacatcgtaacccctgtcttactccggcacatccagcatgacatcgcagtctaggttggccagtcgttccaacaagacaatgtggaaattgtagcatatatatatgaccatgtaatctattgttcgtctaatgtaggataccgtgttggatgctctgacatcttaagtccttgagaagctcttcatgtcatttgtgttttttccatgaaacagaaactactacc

SEQ ID NO: 17036 - DNA, 647 bp, Zea mays
  Clone ID: LIB3279-215-Q6-K1-H6
cacaaaacaaatcggccaaagcgagccaagtgattcaaacagacgagccccgagagaagaggagataaagcagagcgccatggcaacagcggtcagcggcaggtggacgcgcgtccgcacgctgggccgcggcgcgtcgggcgcggtggtgtcgctcgccgccgacgccgcctctggcgcgctcttcgcggtgaagtccgcccccgcgtgggccgcggagcagctgcggcgcgaggggagcatcctgtcgtccctccggtccccgcacgtggtcccctgcctcggccaccgccccgcggccgacggcgggtggcagctgctcctcgagttcgcgcccggcggctcgctcgcggacgtggcggcgaggagcggcggcgggcgcatcggcgacgagcgcgccgtcgcggcgtacgcagcggacgtggcgcggggcctggcgtacctccacgggcggtcggtcgtgcacggcgacgtcaaggcgcggaacgtcgtggtgggcgccgacggccgcgccaagctcgcggacttcgggtgcgccaggtccgtgggctccgggcgccccgtcggcggcacgccggcgttcatggcgcccgaggtggcgcgcggggaggagcagggccccgccgccgacgtctgggcgctgggct

SEQ ID NO: 17037 - DNA, 634 bp, Zea mays
  Clone ID: LIB3279-216-Q6-K1-A2
gaaccgcatgagatctgcagtacctcttcaggagggcgtgctgtatgccaagaaggactacaacctggcgaagcacccgcagatcgatgtgcccaacctccaggtgatcaagctcatgcagagctttaagtccaaggagtatgttagggagaccttctcctggcagtactactactggtatctcaccaacgatggcattgagcacctacgcaactacctgaacctcccgtctgagatcgtgcctgccacgctcaagaagtctgccaagccacctggccgcccatttggctctggccctcctggtgaccgcccaaggggcccaggccgttttgacggcgacaggccaaggtttggtgacagggatgggtaccgtggtggtcctcgtggtgctcctggtgactttggtggcgataagagtggagctcctgctgagttccagccatcattcaggaggcctggctttgggcgtggtggcggcagcggcttcggcgcgggcccaacctcttcttccatggagtgaagttgcccttggtttggacatggtgtttcccttcgcatgtggcctttagttttgaaggacagttattatgtactagtaatattactcggatcggccagtgctgacatatgcaaa

SEQ ID NO: 17038 - DNA, 363 bp, Zea mays
  unsure (1)..(363): unsure at all n locations; Clone ID: LIB3279-216-Q6-K1-A3
gcccattcttcagtcttaatgtcattgccgccgagtacaatagtgattccccggtgcatccacaccaagnatttcatcaccactagccccatcaacgactacaatggtgaagagtttgtcttctactctacaaggaagtaccgtgccaaaaactcaataatagagtaccacaccaaccaaaatggctaattgttgccactagagagaatgtatagcctattttgtctggcacttagtgaatcgatagctttaagggcaagttatgcactcgagtgactacaatagggaagggaggccttccaaggcaagaaagtgctcgttgtcggttgtaataacacctttccaaaaataatgttcatgcct

SEQ ID NO: 17039 - DNA, 633 bp, Zea mays
  unsure (1)..(633): unsure at all n locations; Clone ID: LIB3279-216-Q6-K1-A4
gttccaactcctgnacactttctcctcgtcccagaacaagccaatcgaagccgagatacgaccatggactccaccggcnaccggacagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgt

SEQ ID NO: 17040 - DNA, 636 bp, Zea mays
  unsure (1)..(636): unsure at all n locations; Clone ID: LIB3279-216-Q6-K1-A5
ctctgccttccctacctcanatcctccctcagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctgacggacgaggaggtggatgagatgattcgtgaagccgacgtggacggtgatggccagatcaactacgaggagttcgtgaaggtgatgatggccaagtgagatgatgtgcctgttttgaagctagttcctctcttgatggtagtagctagtctagtgttggagactgactgcatttggtccgccttgttcctctcgctgcatcaatggacatatccgtttgttttctcccaaggattttaccatgtcg

SEQ ID NO: 17041 - DNA, 352 bp, Zea mays
  Clone ID: LIB3279-216-Q6-K1-A6
aaagtttaggactcctattgttctggatggggttacaactacaaacttcaatagcttcgtttcaactatcaccttgcacatacctgatgtgacggtcattacacttcaaggtgagccccggactgacaagaagaggtctcaagactcagcgtctctgctaatgcttaagaaattcgaagaactcggagtctgcatatgcgagacgcagccaagcaacatggataataataataatgccagttaatggacaacactgattaatgttggggttactatctccctcccaatgtgatttctgttgaaaatgtctgtgagacactcgatactacgtaaagtattaatttgctggtcc

SEQ ID NO: 17042 - DNA, 371 bp, Zea mays
  Clone ID: LIB3279-216-Q6-K1-B1
cggccgcgtgggttgcagtggacaagtgggggcggattgaggctgtagagccagccagtttcacggtgaaggaagacaacaacctgtctctaatagagtatgaattggttaatgtggctgagtaactgtccaatccaagcgtttctgccccctttatttcgtgccataagaaggaagtaccatgaatgaacattataaagcctcttgaagcgaagcgagtttatttgctacggtggggtagataaaggtcaaggctgtatggcctgtgttagaactttggataaattaagatgaattgcccttgcatctatgagattgttatccatctttgtactgctcgtgttgctttgatgcaagaaatctgaagcagg

SEQ ID NO: 17043 - DNA, 333 bp, Zea mays
  Clone ID: LIB3279-216-Q6-K1-B2
actgaccaactgttgggtggtgccaccatcgcgagcggaggtgttatgcctaacatccatcagcatctgctccccaagaggctgcctcctccaaggccagtgtcgacgacgacgacaactgagactgcttcctgcagaaatgatccgaccaccgccttgttttgtaggaataggatgatgttgtcttcggggaggagtcgggtttgttgggaaggaaaattagattagtatcagtttttttgaatgggatgggaacgtggctgtgaatctcagggttgtatgctcgttgagaaagaaatggaaggacttcgtgatgcacgatgttgatgccgc

SEQ ID NO: 17044 - DNA, 638 bp, Zea mays
  unsure (1)..(638): unsure at all n locations; Clone ID: LIB3279-216-Q6-K1-B4
ctaggacgcgggcggccgcccgcngactagcagcgccttcggcacgagcacgaccaggcctgcgcaggagatggggcggagaggggagccctactacgtcgaggcggtgccgccggtggacgtgaacaagaacacagagtggttcatgtacccgggcgtctggaccacctacatcctcatgctcttcttcgcctggcttctcgtcctctccgtctctggttgctccccgggggcagcctggaccgtcgtcaacctcgcgcacttcgccatcacttaccacttcttccattggaagaaaggaaccccttttgctgctgatgaccaaggcatctacagcagattgacatggtgggagcaaattgacaatggtcagcagcttactcggaacaggaagtttttaactgtggtacctgtggtgctgtatctgattgcgtcgcacttgaccgactacaagcagccgatgttttttctcaacacgattgcagttttcgtgctggtcgtggcaaaattgccgaacatgcacaaggtccgcatatttggaatcaatgcagacatctgaggacagctgcaagaagtacatggatgcgatgccatgatgttatgaacaagcagtgtgtttctcaaactcgacacaactg

SEQ ID NO: 17045 - DNA, 628 bp, Zea mays
  Clone ID: LIB3279-216-Q6-K1-B5
gcgctcgttcgttcgcgaagcgccccttcctgccctcacatccgctcctccctccccgacaccgaccgaccccctcgtccgatcgcctccctcctcgatccccgccgccatggccgccgccgccgccgcgtcctcctcttcctcatccgaggttccgatcgccgcccgcacctgcgtctccgtcggcgaggtggcggtgggagcggtggctacaagcagcggcgaccgggtggcggcggattgcggggtgtgcgccatctgcctcgacaggatagcgctccaggagacggccctcgtcaagggttgcgaccacgcctactgtgtgacctgtattttgaggtgggcatcctacaaggagaaccctctctgtccacagtgcaagcatccattcggattcctcagcgtgcaccgctctctcgacggctgcttacatgactacctgtttgaggagagtgtttgcctccttctgagggcagcttggtttgaacctctgatcgtagaggctcaggaagaggctctggaagaagaagagtttctccaccagcagtaccaatacgatgatgacgaagatgatcttgacgaggaattttattacatgagcaggtccccaagcatccgtattggtaac

SEQ ID NO: 17046 - DNA, 495 bp, Zea mays
  unsure (1)..(495): unsure at all n locations; Clone ID: LIB3279-216-Q6-K1-B6
gtttcatgttacacactttttatctcccttaataactctgctagaaaccttagttctgctgtttggcttagatttttacactactcaggccaggtatctttttctaccaaaacttatgtgcataattatgattaatgtggctttagtagttgatccatgaaaattgtcaatcatcaaccatttcttttcctggaaccgttgtagtgtacaagagatcaagctttggtttgtagacaatggtgccctggctagaaccgcgaggattgggcctatttcctgactgtctagttattgtctcagaagtctggtttagataaggttctgtttccgcggcaaactattagatacctttgcagttgcggagttctgtaattgatgtattatttatgcagatagtgtagtctaactatgcaaactaatatatgatctgtttcagagttttgagaaaaaaaaaaaaaaaaaaaaaaaaaaaaaaaaaaaanaaaaaaaaaanaa

SEQ ID NO: 17047 - DNA, 61 bp, Zea mays
  unsure (1)..(61): unsure at all n locations; Clone ID: LIB3279-216-Q6-K1-C1
ctgttgtagnntgttgttccacttgtactttatgcaatgattgcaggnatnntactttaat

SEQ ID NO: 17048 - DNA, 624 bp, Zea mays
  unsure (1)..(624): unsure at all n locations; Clone ID: LIB3279-216-Q6-K1-C2
agnacctcaaacagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagatatgatctgtatcttggaaccttatttcaatggaccaaatttctttctttgcc

SEQ ID NO: 17049 - DNA, 629 bp, Zea mays
  Clone ID: LIB3279-216-Q6-K1-C3
ctcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaagggctcgttcctcgacaagggcgaggtcgctgaccgtgtcgtctccgtcgtcaagaacttccagaaggtcgaaccctcaaaggtgacacctagtgctcattttcagaaggaccttggacttgatagcttggacactgtggagatcgtgatggcgtttgaggaagaattttcctttgagattcctgacaacgaagcagagaagattgactccatcaagacagcggttgatttcattgcttcgcatcctcaagcaaaataagaggatttcttttttttcgtatttcaaagtgtgttttgcatccagaacttatgcgacacgggactagttttctctagcttgccgcagtagataggaagtcatttctttacctttctgaatccgcgtgtaccaaacgattgttgtgttcttgtgacctcattggtacgctaatccataaatccatttgggcttc

SEQ ID NO: 17050 - DNA, 478 bp, Zea mays
  unsure (1)..(478): unsure at all n locations; Clone ID: LIB3279-216-Q6-K1-C4
ccgcattgcgcatgaccacgaangcgccagagttctctgagaagacatcgtgctgctcatcaccgtagatgcgctcgagggacctgactacatggtgaggaccgcgaagaaatctatgctagaggagctcgaagcaatgctggaggttgtggaccctcagcccccagggaagcagcgatcactgagccgcaggaaatttgatctcccagagggtggagccatccccgatgagaaaaccgctgctgtgaacaaagccatcaggatcatcgaggaaggcaagtgaagtgatgcaccaccaccttgttactggcaggattgaatcctgatgaaagctccatatctatccgtgtatcgtctaggagaagtttatatccgtgtgctttgctgacactcgagggaggagaactaatatctgcactttattgtaccttaaatgatagccatgtttttattgtgaacctgtagtatgttgctaggc

SEQ ID NO: 17051 - DNA, 632 bp, Zea mays
  Clone ID: LIB3279-216-Q6-K1-C5
ggtcgcccagcgtcccgattcccaccaactccatgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttcgccgtcgcagcgcagaactgctgggtgcgcaagggcggcgccttcaccggcgagatcagtgctgagatgctggtaaacctgcaggtgccctgggtcattttgggacattctgagcgcagagctctgttgggtgaatccagtgattttgttgctgataaagttgcatatgcactcactcaaggtctcaaggtaattgcttgcattggtgagacccttgagcagagagaggcaggaacaacaatggatgttgttgctgcacaaacaaaggctattgctgaaaaaattcagattggacaaatattgtgttggcatatgaaccagtttgggctattggtaccggcaaggttgcaactcctgctcaggctc

SEQ ID NO: 17052 - DNA, 537 bp, Zea mays
  Clone ID: LIB3279-216-Q6-K1-D2
cccagcgtccgctgatctttacaccttggttgatggctttgtcatccgcaatccatccagagcgaatccagctaacccttcgattgagcttggacctgagttcaagaaggttgccaatttccttgctcggttcaagtccatccccagcatcgtcgagcttgacagcttgaaggtttctggtgatgtctggtttggttctggaattacgctcaagggcaaggtgacaatcaccgccaagtctggagtgaagttggaggttccagatggagctgtatttgaaaacaaggatgtcaatggccctgaggatctttaagctatgcttgccgtcaccagtttttcccaaggatttgtcaataggagcagccaacccaaatcactcccactgagctctaccttttgtaattctcgtgccattccgctcccgctgtgagggtcctgtgagcccgctagagaatatgactgtaatcttctttggtgcgtctgcccttctgtttttgtgcgccagggacgtatattttgctgaaatgatactaccat

SEQ ID NO: 17053 - DNA, 627 bp, Zea mays
  unsure (1)..(627): unsure at all n locations; Clone ID: LIB3279-216-Q6-K1-D3
ngtgatcctacatagnatcaagctaccataaatacattcatactgctctataacaaattacaagaccaacttgtgcgaaatcatcaaggtcctcggtacgccaaccaagggaagaaattaaatgcatgaacccaaattacacagagtttaagttcccacaaatcaaagcacacccatggcgcaggggattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattgattccagaacatgcaaagaagcaatgctcctatgttggattgtgaaatgaccgcgccttgagactggaacctgtggttgcaactgtgcatttcccctgggatgtttgacgatctgaggcatgcgagcctgttgttgaagatgcaaggttacgtacttgtacgacaatgtgacctgtgtagctgagtagtctatgtcgccatgacatgtaacggcacc

SEQ ID NO: 17054 - DNA, 304 bp, Zea mays
  unsure (1)..(304): unsure at all n locations; Clone ID: LIB3279-216-Q6-K1-D4
ngatggntatcaggttttttagctgccaccttgtaatgtaaatggagaagtgattcttgcctgcgtccattcaaagtgttgactttatagcagttgttaatgtttttatatttcatcataagccttgcataattggttctcagagaataatacaatccttgtcttttactctatattaggctttggatgtgcaataccaggtgcatggccgaagacagtgtcatacttgtttacagacgagtaccttgctggaagttttggagggattgtccattccaggagtgcgacggcttgttgttattga

SEQ ID NO: 17055 - DNA, 639 bp, Zea mays
  Clone ID: LIB3279-216-Q6-K1-D5
gtcgcgccgcggcagcaagaacgatggatgaggaagccgagtacctggagacggctcgggccgaccgctccgtgtggctcatgaagtgccccccggtcgtttcccgcgcctggcaggccgcctccgcctcttcctccgatgctgccaacgccaaccccgtcgttgccaaggtcgtcctttcccttgacctgttgcgccaagaagaacgcccggaagagcctacgctccagttcaagatggaattggctcaaactaacaccgggaatacacctaagagctactctttgaatatgttcaaagatttcgttcctatgtgtgttttctccgaatctaaccaagggaaactttcatgtgaaggaaaagtcgagcataaatttgacatggaacctcacagcgataatttggcgaactatggaaagttatgccgtgaaagaacacaaaagtacatggttaaatctagacaagtgcaggtacttgacaatgaccatggaatgagcatgaggccaatgcctggcattgttggtctcatatcttctagttcaaaggaaaagaagaagcaagcaccagtgaaaccatctgatgccaaaagaactcgtagggatcgcacggggatggaaaacgttatattcaagctttttg

SEQ ID NO: 17056 - DNA, 514 bp, Zea mays
  Clone ID: LIB3279-216-Q6-K1-D6
ccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcatgcttcttaaaaaaaaaaaaaaaaaaaaaaaaaagggggcg

SEQ ID NO: 17057 - DNA, 642 bp, Zea mays
  Clone ID: LIB3279-216-Q6-K1-E1
ggcgtccgtccgcgcgtacggcagcagcggggtcgtcgctcgctggccgagcccgtacaccgtcgccagcggagccctgctgctggcgtccctgttcgcgccgctgctaccttccctgcgctggctggccctggcggcggcctgcgccggcgcgccgccgatggtgctcagggcgctggccgcggggctcgccctggacatcaacgcgctgatgctcgtggccgtggccggcgccgcggcgctcggcgactacgcggaggccggcgccatcgtgttcctcttcaccaccgcggagtggctggagacgctggcgtgcaccaaggccagcgccgggatgtcgtcgctcatgagcatggtcccgcccaccgtcgtgctcgcgcagacaggggaggtcgtcggcgtgcgcgacgtcggggtgggcgccgtcgtcgctgtccgggccggggaggtcgtgcccgtggacggcgtggtcgtcgacgggcagagcgaggtcgacgagagcagcctcaccggcgagtccttccccgtgcccaaacagccgcaggcggaggtctgggccggcaccatgaacctggacggctacatagccgtgaggacgacagctctggccgacaactcgacagtggccaggatgcagcggct

SEQ ID NO: 17058 - DNA, 620 bp, Zea mays
  Clone ID: LIB3279-216-Q6-K1-E2
ctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacgtcgtgtacgccctcaaacgccagggccgcactctctatggcttcggcggctaggttaggtgtgggtaattgcctgtccaggtgtctcggatctgtggtactagtttggctgccttcctgtgttcgtattgtagcagttgtggtagctggttgctttgtcgtcctgtagtcgtgcttctttgggtctgtaagaaccgctggttcgatgggattggattggacggtgaagtaggaatgttggcatgttagacttttctccaacgtagcgttgcctctaatttgatctctc

SEQ ID NO: 17059 - DNA, 621 bp, Zea mays
  unsure (1)..(621): unsure at all n locations; Clone ID: LIB3279-216-Q6-K1-E4
gcctcaacccctgataaagctgctccggnagtccaaaatgaccagggccttgtcacgcaagggttcgaatcggatggaaaggaagggtggtgatgagctgctggagcaagaggatctggnccagaaaacttatcatcaaagttgtgccatctcagctggagcagcagcgggccctggttgctccacactgcactccctgcgcgcctgtcctcctcattgactccgcggaaggaaggagcagcaggaggtttggccggctcatcacgcccgtcaataaccctcggaggattctgctcttattcgcgacgctgtcgagcgtggggacgacgatactgatctacttcacgctggcgatcaacagcagagcagaggcctagtcgtctgaagaggaccaggggagatcagatgcagcgtgtctgtctttattcgtgagcgagtgagacgatggatgagggnggagttgtacccccttcttcctcgcgtgtatgtatatcggttgctctcatgctctgtgtgcctttttttcttcatcttcttcttgtagatgaacgttgaccttgttgattttcctctcgatngcnnnnnnnanaaanaaaaannnaaaaaaaaaagggcggccgc

SEQ ID NO: 17060 - DNA, 637 bp, Zea mays
  unsure (1)..(637): unsure at all n locations; Clone ID: LIB3279-216-Q6-K1-E5
cggccgcgtggngaaattgcaagtagatattgttacccttaagatgaaaagtgaaattagaaagcatgttagaagaagccagagcttcctgggacactcttgctgattcaatatcaagccttacnntcttcctattgatcagcctttntgaggggnncctatggaaaagtttagccagattgcccaatacatccaggaatctcaagttgctaagagttctcttgaaaatgagctacacaaagcaaatgagcaaattaccttacatgctagcaggcattctgacgccctttccaccataaacatgttagaacatgagttgagtaaactaaaagatcatatttcttccatttctgaagaaaaacgtcaaatccagttaaatacttctgctgtacaggaggagttggagaaaacaaacgaggaactggcaatcaatttgaggaatcttgaaaatgccaacaccaccattaattcactacaagatgcactatcacaggctagatcaaatatttttattcttgctgctgaaaagatgaagctgaagctaaatatgaaacagaaataaatgctcttaatgctgagctaaccaaatgtttggnaggagttggataaaactcatgggcacttacaaagtcattca

SEQ ID NO: 17061 - DNA, 653 bp, Zea mays
  unsure (1)..(653): unsure at all n locations; Clone ID: LIB3279-216-Q6-K1-E6
ggggntcatgaatgaaatcgctgaactagnacagaggaatatcattgagatgcacaattatctcacaagtgtttacgaggaaggggatgctcggtcagcactcattacgatgctacaagctctcaaccatgccaagaatggtgttgatatagtttctggaactaaagtgcggacacattttgcaaggccaaattttaaaaaggtcttatctaagatagccaccaaacatccatatgctaagataggagtgttctactgcggggctccagttctggcacaggaactaagcaagctctgttatgaattcaatggcaagtctacaacaaaattcgaattccacaaggagcatttctgacatacaacaaggttaatgcagaatagtggaacaagggggagaagatgtgatgtatgtaagtcacttgtgctttaacatgttgctttcttggcgatgagtttgaaagagcaagggattctgcacaaggtgttgtatcaccacagcttactccgcacttgtgatactactgccccccagttacaactgcattatctattgcttgagatactaaaatacaataagatcgcatagaaaggaaaatgggggtcagctagcacatcacacaaggtttccatcgaaggttcaagagcacataccc

SEQ ID NO: 17062 - DNA, 634 bp, Zea mays
  unsure (1)..(634): unsure at all n locations; Clone ID: LIB3279-216-Q6-K1-F1
cgcagnagcgcagnaccaggcgtcttcgtactcgcctatctccgcgactcaaagcttcttccatttcctaccgccgccgctgcagctccaccccattccgtcgacaccatgagggagtgcatctcgatccacatcggccaagccggtatccaggtcggaaacgcgtgctgggagctttactgcctcgagcatggcattcaggctgatggtcagatgcccggtgacaagaccattgggggtggtgatgatgctttcaacaccttcttcagtgagactggtgctgggaagcacgtccctcgtgctgtttttgttgaccttgaaccaactgtcatcgatgaggtgaggactggcacctaccgccagctcttccaccctgagcagcttatcagtggcaaggaggatgcagccaacaacttcgcccgtggtcactacaccattggcaaggagattgttgacctgtgccttgatcgcatcaggaagcttgccgacaactgcactggtctccagggcttcctcgtcttcaacgctgttggtggaggaacaggctctggccttggttccctcctcctggagcgtctgtctgttgactacggcaagaagtctaagcttggtttcactgtacccatccncccaa

SEQ ID NO: 17063 - DNA, 641 bp, Zea mays
  Clone ID: LIB3279-216-Q6-K1-F2
cggccgcgtaggctgctcccggctcccccaggtactccagccgctagcctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttccatcgaagcaagctcttggccgtgcttgtggtgtgacaagaccggttattgcttgctcagtgaccagtaatgagggtagccagctgaaactacagatacagggtctcaaggactccattgagaagcttctcatctgatctgccgaagacctttcagtgtgatgggcctcatcgacacttttttcagaggcttggactggtgatggtgtcttgtttactttgcgcttttcaaactatatttg

SEQ ID NO: 17064 - DNA, 651 bp, Zea mays
  Clone ID: LIB3279-216-Q6-K1-F3
cgggaaaacgacctcagcagacaaaagccagacgagactcagagagcgagcaccgtgacctctctgtttctctctcttcccttctcgtcttctgcaagaagccacaacaaatgtgaccgtctctgtttctctcatccccttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagctaccgcggagcagatgtgttcgtgctcgccttctcgcttgtcagccgagctagctacgagaatgttatgaagaagtggctaccggagcttcagcattatgcaccgggtgtccccatagtgttggccggaactaaattggatcttcgtgaagacaagcactacttagttgaccatcctggtgcggtacctgttactacagcacagggggaaggaactgcgcaagcacattggcgcaacttg

SEQ ID NO: 17065 - DNA, 635 bp, Zea mays
  unsure (1)..(635): unsure at all n locations; Clone ID: LIB3279-216-Q6-K1-F4
agcgaacannagcactgaacagagcgagcgagctgtccggccaaccctcaggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctccacgccgctggacttcccggcgaccgacctcgccgcggacgccgcgggcggcaagatccgggtgtacggcaagctgcagctgcgcaaggggatgaaggccgtgaaccaggtgtggcaggtcggcgcgtcctccacgggcggcgcccccgacaagcacgcgttccaggcggacaacctcggcgccaagacaagctcgtcctcgccggc

SEQ ID NO: 17066 - DNA, 290 bp, Zea mays
  Clone ID: LIB3279-216-Q6-K1-F5
tctctaaggagtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgcc

SEQ ID NO: 17067 - DNA, 614 bp, Zea mays
  Clone ID: LIB3279-216-Q6-K1-F6
cggacgcgtggggccagccagggcgccaagctctctctctactacaaggaagctaccatcacctggaacaagatacatgagtgcgtgcaccttgggctgcccggacagctggggaaggaggcccgctatgaaggaatcaagggcagaagaaggttcacgctgctactaggttcgagcggtagcgctttgtaggctttgcttgcgtcgatgtcgactttgtgtagtgggtagatgttgccgttttcattgtcacgcgctagctctgcttctgtacgaactgagcgatgtaactgaccaaggagttgcaaatatgggaatcatcaacagtttggtggggattactgattttgcaaatgcttgatgcggagctcccaaggaggagaagaaggaagaggagaaggaagagagcgacgacgacatgggattctccctgttcgactagagttgtgtgtgtcatctggatctcaggagtggtggtttggagctgttgccgtagttaattttgctgtcctgtctgtgaacctgaagaactgttggtaattgttacaagcgagctgttccagtttatgtgagaatttgataaaaagccttggaatcatatattataacttgcc

SEQ ID NO: 17068 - DNA, 525 bp, Zea mays
  unsure (1)..(525): unsure at all n locations; Clone ID: LIB3279-216-Q6-K1-G1
ggnaaatgccattggcaaactacatgatggaggccttgttcatggtgatttgaccacgtcaaacatgataattaagaacagtaacaatcaattggttcttattgattttgggctgagtttcacttcgacaattcctgaggacaaagcggtggacctatatgtgctagagagagctttgatttccatgcattcgtcctgtggggatgtgatggagaaaatcctggctgcgtacagaaaggcttcgaagcaatggtgctccacccagaacaagctggctcaagtgaggcaacggggcaggaagcgcaccatggtcggatgaatggagaagaagaaaaatatgtggcatggaatggatttatgtgattagaaagaccgtcgtctaaaacgagagtgatgtaccaccattgctgtattttttttagcggtgagtggctttggctgctgtaacgtttgtgaaatctggaactatgttgcccggctgcaccatttggtcagaactcagaagcagagtgtcgtttcatccgg

SEQ ID NO: 17069 - DNA, 641 bp, Zea mays
  Clone ID: LIB3279-216-Q6-K1-G2
catgagctctgggttaccaagtcgctgccttttctcgtggctccggcagtggcctcgcccactgccgccctccagctcacctccatggacagagctctggtttccctgcccgtgtcagcgatgttcgtctacgagaaccccatcgatcgtccggccgagaccattagaagagctctgtcccgtgcgcttgttccctactacccaatggccggccgcctcgccgtcactggggaccagctgaagctcgcgtgcaccggcgagggcgtagcgttcgtcggtgcgtcggcgagctgcaccctgcaggacgccaggctctgcgaccggcgtcccgtggtcagtgtcgaggacctcagtatcagctatgccggccagtacagcgaggaccctccacttctgctggtgcaggtgaccgagttttcctgtggcggcttcgttgtcggggtgacgtggaaccacgtcctcacggacggcgccggcatggcgcagttcttgaaggccgtcggcgagtttgcccgaggttccccttccccttccgtcttgccgatgagggtggacgacaccctctctgaactccccccgccaataaccaccatgactaaggcactcgtcagcagcaagcccagagacatgccgtcctccta

SEQ ID NO: 17070 - DNA, 608 bp, Zea mays
  unsure (1)..(608): unsure at all n locations; Clone ID: LIB3279-216-Q6-K1-G3
ctcaagcattagnatactgccattcacaaggtattatgcaccgagnagtgaagccccacaatgttatgatagatcatgagcttcggaaactccggctgatagactggggccttgctgaattctatcatcctggcaaggaatataatgtccgtgttgcctccaggtacttcaagggtcctgagcttcttgttgacttgcaagattatgattactctctggacatgtggagtctgggctgcatgtttgctggaatgatttttcgtaaggagccatttttttacggtcatgacaaccatgatcaacttgttaagatagccaaggtacttggaacagatgggctgaatgtctatttgaacaagtacagaattgagcttgaccctcagctcgaagcccttgttggaaggcatagcaggaaaccctggacaaagtttattaatgcagacaaccaacacctagtgtctcatgaggccatagatttcctcgacaagcttttgcgttatgatcatcaggacaggcttactgcacgtgaagctatgacacacccatacttccaacaagtgagggctgcagagaacagcaggacgcgggcatgagaggccaaagaccaa

SEQ ID NO: 17071 - DNA, 283 bp, Zea mays
  unsure (1)..(283): unsure at all n locations; Clone ID: LIB3279-216-Q6-K1-G4
cggccgcgtgggcggccgcgtgggccggcaagnaggggcggcgagnaaaaagggggaagaagaaggccaagaagagcgtggagacctacaagatctacatcttcaaggtgctgaagcaggtgcaccccgacatcggcatatcctccaaggccatgtccatcatgaactccttcatcaacgacatctttgagaagctggccggcgaggccgccaagctggcgcggtacaacaagaangccaccatcacgtnccgcgagatccagacctncgtgcgcctagtcct

SEQ ID NO: 17072 - DNA, 85 bp, Zea mays
  unsure (1)..(85): unsure at all n locations; Clone ID: LIB3279-216-Q6-K1-G5
naacgcggcaatcgcgacgcccggggaggcgttcgttctccttctcctcccagcgcgcgcatccaggccggatcggcggcctctc

SEQ ID NO: 17073 - DNA, 620 bp, Zea mays
  unsure (1)..(620): unsure at all n locations; Clone ID: LIB3279-216-Q6-K1-G6
ctttttctcccctctgtcaatttttcctcaaagagttttgaaacaggagcctagttggactttttgaagagcatgccaaaacttcnatagaaaaccatgcattttactcttgttatcaaacattttacagtggattgtaatctcgacaagcgcaagtgacagctgccagcctgctagcctacaaaacttatgatcagttacggatgctttaacatggatggacaataatcgtcagtgctgcgagcatccagattacctgatgcatatttttgactagtcttcattggtcacatgctttgcttctctatcctgaactccattgtacctgatattcagaacctatttcgtgcttgtatgagttgtggtccttgactgttgtattgatttgggttccattagatgattgctagcatgcattattgactttaaatgcctagcgtgaaatgtgaatgatggagcatcccttanaaaaaaaaaaaaaaaaaaaccananaaaaaaaaaaaaaaaaaaaaaaaaaaaaaaaaaaaaaannaanaaaanaaaaaaaaaaaaaaaaaaaaaaaaaaaaanaaaaaaaaaaaaaaaaaaaaanaaaaaaaaaaaaaaggggggccctttt

SEQ ID NO: 17074 - DNA, 268 bp, Zea mays
  unsure (1)..(268): unsure at all n locations; Clone ID: LIB3279-216-Q6-K1-H1
gttcattctttttcttgtgctacttgattttatgttactgtaaattagtggtcgagacttctcacggtgctgttctttaaaacatagcaaccgtgaagggacatggtnggaaacacagagggcactataacaatatgtatccatatcacctgttttactttctatctcaatgacatgtgcttgtagtttggcttgttcgtgctcttacgcttgtgaagctgtgtccagtggtgacgattttgaaatcaatagttctaaatttcaagcc

SEQ ID NO: 17075 - DNA, 637 bp, Zea mays
  unsure (1)..(637): unsure at all n locations; Clone ID: LIB3279-216-Q6-K1-H2
cggccgcgtgggggngaaccaatgtcagtttcattgattgcttcttcgatcctggcccacatggaactggaaggtatacgatggaaagcttcctgaaatagaacagagggacttcaggaagggtgcccagtggtttgctataacacgaaggcatgctttattgattctggcagacaacctttactacaataagttcaagctgtactgcaagccagcagaaggacgcaactgtattgctgatgagcattatttgccaaccctcttcaatatggttgaccctggtggaatagctaactggtcagtgactcatgttgattggtccgagggaaaatggcatccaaggtcatatagagctgcagatgttacatatcaactcttaaagaacataacgtctgtcaatgagaatgttcacattacaagtgatgataaaaagttgtgacacagaccccatgtatgtggaatggaacaaaaagaccctgctatctttttgctagaaagttttacccagaatctttgaacaacctgctgaagctattctccagttacacatcggcttgagttctacatgattcttttggcattttgcctaggagattcctctaggatttatctttttgtgcttcatgtaaattgtgga

SEQ ID NO: 17076 - DNA, 623 bp, Zea mays
  unsure (1)..(623): unsure at all n locations; Clone ID: LIB3279-216-Q6-K1-H3
actgcacgagnanaagacgacgagnaggccgatgcggaggacgccgccgccgcgcgccgacgggccgccataaccgactaccgcaagaagctgctcaactgcagggagctcgagtcgcgcgtcggcaccgtgagagaaagccttaaaaatgcaaagagggattttaccaagactgaagacgacttgaaatctctgcagagcgtggggcaaataattggagaggttctccgacctcttgataatgaacgctttattgtgaaggccagcagtggtccccgatatgtggtcggttgccgaagtaaagtagacaaggagaagttgacatctggaactcgtgttgtacttgacatgacgaccttgacaataatgcgcactcttccacgggaggtggatccagtggtatataacatgcttcatgaagatccaggaaatgtcagttactctgctgtaggcggtttgtctgatcagattagggagctcagggagtccattgagttaccacttatgaaccctgaactctttcttcgggtgggaattaagcctcctaagggtgttctactctacggtcctccgggaactgggaagaccctattggcaagggctatcgccagtaacatcgatgc

SEQ ID NO: 17077 - DNA, 443 bp, Zea mays
  unsure (1)..(443): unsure at all n locations; Clone ID: LIB3279-216-Q6-K1-H4
gtcggccccgcggcgtcggtcntacgacgtgaggtggtcggccccgagtccgtcgccgtcacggtgacgccggcgaggctcacgttcaggcaggccggccagaagctcaggtactatgtcacctttgcgtccagggctcggcaaggccacgcgaagccggacttcgggtggatttcctgggtcaacgatgagcacgtcgtccgcagccccgtcgcgtatacgtggaagatgtgatgtgaggttccctgcctgcctaaagtctagctcgatgacgaaggaataggataggttggtgtagtttgctcaccgcttcgcaaagagaatcggcgtgaagctctctatctctctctctcggctgcagacctgtacttgtttcctatctttcttttcggacatcaagtaaccctgaatctgaatgacgaatccgccgtttggtgtttgcc

SEQ ID NO: 17078 - DNA, 636 bp, Zea mays
  Clone ID: LIB3279-216-Q6-K1-H5
cggccgcgtggggcaaactgtaaagatccagtattgccatcccgagtaaaagagctcctgaagcagaagcccagccgcagaaggaagtagaagagaatgggcatgttcctgcccttgaaacggaagcccagccacaaaaggagccacatactgaaccggaagtggcagatttgcatggacaattggaaaaatcggtcacatcttatgccacacctgaagggactccaatgagccgaacgaccaccattccggagtctcatgggacaccgtcaagtgaggtctctgttaacaccaaaaggagcaggagcaagaagcccaagtcccacgcgagcaagagggcgctggctagtccaggcagcgactcagttggacggagcagcaccgagaacttttcgaaggaatcaaggcatgccaagagagagagctcctcaagcaaagctgctaaatccgaccagggcgatcaagaacctcgtgtaagcaacagcaacagcaacccgttgcctagctacatgcagttcacagagtccgcaagagccaaggcgtcgtccccgaagatgagcccagacgtgcaggacagcaacgccgcgaggaagaggcactcgttgcccatgaccaacggcaagcacgactcgtcgc

SEQ ID NO: 17079 - DNA, 484 bp, Zea mays
  unsure (1)..(484): unsure at all n locations; Clone ID: LIB3279-217-Q6-K1-A1
cggncgcgtggggggactgcgtcggagtggagatccgtgccgacatagtccgactttatcgctcgctgcctacgattgatggcctcaccttcaccaaccgagttcagtagggaagcagctcgtcagtctctcatcgcaatctcccagaccattccggagacaccttcacccgagacggtgaaggcaccgatctccattgcagaaaacgggaagctgggcgatggggcggataagttcagatcaaagctgatgtccatcacagacctgtcttctgatgcccaacctgcgcagtgccctcccgaggatattgctgcttgatcgtgtgattttcctgctcgacttgcggacataatgtatcagtgcttgctgatgctctgggcatttaactgtcgtgcattaaactgaacgtccttgtgttactagtcgtttttctttgttaaaatattcagggaaaccggtggaaatatattgtgcaagttttctt

SEQ ID NO: 17080 - DNA, 494 bp, Zea mays
  Clone ID: LIB3279-057-D9-F1B
gtaaaaagagagttagcagaggatctctgatctgcctttgtcctgcagtttgtgttacaagcggttttttcttcttctgcaaacatccacccatacccatcgtcgcccttgcttggtctggtggtgcttgcagattcgtctctcccaacccaaagcagagagtaatcaccgtaccattactactagcaacatcagcagccgaacggatgcggagctgttagtctgcaatgccacgggcaccagttcaatggtggatcgccattctcctcctctctcaggctcaggccatgttctgttctcgatgatttaactcgggctctaaagctaaactacgcgcgggcacgggttcaccgccgccggggctctcgtcctttgaccggctccgccctcctgtacaccgccgcctggccggcccgggccggccccccatcacgccgcgccgacgccgaggaagtcgaagaagggcagcgagaccttgtcgtcggaacgcgccg

SEQ ID NO: 17081 - DNA, 321 bp, Zea mays
  Clone ID: LIB3279-057-D9-R1B
agtctccacaccccaacttctctcctgaaaaccgcctacggtcaggacccgagacaagatgaccgcctacatcggtgctgcaccgcagccggctctcgcttcgttccgccacgaggaggaggaggaacagcaatcaagacgccgccgaagaggtgtaccacgtggacgatgtcaacgagggcaacggtgacggccgtggccacggcggcgccggccaaggagaactgaacgccagaggcaactgacacaccgccgaggacgccaagctcaaggaactcatcgcgcagttcgggccccagaactgagacctcatcaccgaaa

SEQ ID NO: 17082 - DNA, 291 bp, Zea mays
  Clone ID: LIB3279-200-Q1-K6-A1
ctttgccctgttctttaaccagggacaatgctgctgcgctggatctcgcacgtttgtacatgagcgtgtttatgatgagtttgtggagaaggccaaggctcgtgcattgaagcgcgtcgttggtgatccgttcaggaaaggtgttgaacagggcccgcaggtacatctctgaattggatatttaatgagttacttagttacaacctctacattgccacccatgaattccatgggagcttctattagtttgacatatcattcacatagtatctgcttcggccggtaactcat

SEQ ID NO: 17083 - DNA, 607 bp, Zea mays
  Clone ID: LIB3279-200-Q1-K6-A10
cggacgcgtgggtgaaacttgaccatacttgtctcaatgagactttggagtgaaccaaatgagcttatgttcttatatgactactagctagaagttagagcctagatgatggctgcttctgttggcgtgaaagctcgagtgctcctaaatggtcgtcgtattagctgatacgacatctacccgatgcaatagataatattgtttacacgcgtgagtccaaaattgttggctttgggtcggagcagttaatgcgagaagtgtattttatcacttctgagtgcaaccttttttttattatttttccgagcttctgcctcttgcatatgttgtagattctcgccgagaagggagtagtagtattacctgatatctatgctaattcacgtggtgtggtcgttagctactttaattgagtgggttcaggtaaaatgcatgttcgtcgctgcttcattgctcgattggttccttgctctaatctgctctcttgcgccatgttgattgatcgcgcagaacattcaaagtttcatgtgggccgaggagaaagtgcacgatgaactatgaaaggacatgagcagtgcttgtcacacatgaaggccatgtgcaaatc

SEQ ID NO: 17084 - DNA, 634 bp, Zea mays
  Clone ID: LIB3279-200-Q1-K6-A11
cagcgtatcatcgttttccatcgctcctactcctatcatccagaaaatctgagcggtattgatggcgcccaaggcggagaagaagccggcggcgaagaaggtggcggaggaggagccctcggagaacgcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggagggtaccaaggccgtcaccaagttcacctcgtcttagcccccttgtagtaggcgtcgttgttgtctgcttctcaagcaagcactgtgatgtgccgcttctcatggtagtagtggtggttggctggtgtgtgtaagtggtgcagtg

SEQ ID NO: 17085 - DNA, 626 bp, Zea mays
  Clone ID: LIB3279-200-Q1-K6-A12
tgaaaagctatgatatgccgtgcaatgtggagtcagcttcacttgaacccaagtctgggagtaaatttgtagctggaggagaagatttgtgggttcatgtattcgatttcttcactggtgaagaaatagcttgtaacaaagggcatcatggaccggtccactgtgtccggtttgcacctggtggtgaatcatacgcatcgggttcagaagatggcaccattaggatctggcagcttagcccagttaatgctgatgacgacgaggcggccaatgcaaatggcaaggcaaatgctgcagtgaacgaggttacaaccaagctcgagggcggcttccacattcccaaggagggacaggctggggggtaggacctcatgtgctttgttgtggtgcttgtggttcttattgcgaggagattgcccatagggctgccacggtcattcagtttctccctgcagagccatcaacacctgtttgcgatccaagggtatcatggcttcaagagtcatcaccctggtaactggggaaaaaccatacccctcgtaagcatggtggtgggtttttggatggggccttcgctttgatagaacatagcaactgtagtgtcaaaaataaacaagagaatacaa

SEQ ID NO: 17086 - DNA, 654 bp, Zea mays
  Clone ID: LIB3279-200-Q1-K6-A2
cccacgcgtccgcccacgcgtccgcggacgcgtgggacacaacagcagctcaaaaaacccaacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctgaagatgtgggagcag

SEQ ID NO: 17087 - DNA, 635 bp, Zea mays
  Clone ID: LIB3279-200-Q1-K6-A3
cccacgcgtccgcccactctttggcgcacgacttggcgagcggcacggccactcctgacctgacccctcccaaatcccaacacctcgtggccttccgccttcgccgcccgtctccgctccgcttccccccgcggggcgggagccgggagtgcgcgctcgcgtccccccaccccctcacctgttcagatctccccggccgctgcctcggttggacctggttgtcgcgcccaggccaagcttggttgtgtccccggcgacggcgatgcggcgaggcgctgcgctgctcctggtggccgtcttcgccgcggtcgccgtagcgaagggtcgtgctgataccccaccagctgaaacaaatagtgatagctctactgcacagccaggccttgggaaattggagcagcatgagcaggcaaatcctaataaggagcatgtgacccaccaggaaggaggagtcatcaatgatattggtgacaacaacaagaaggataactcaacagatgcaaccaacatcagaagagatggctccatacagcagccaaagcacacagatagcattgtgacgaagtcttcacagccactagatttcttggaagatactcttatcagtgagcgtgatccatcacatagatgtatca

SEQ ID NO: 17088 - DNA, 533 bp, Zea mays
  Clone ID: LIB3279-200-Q1-K6-A4
tacaaaagtcaggttggagaactcccttgttcaggcttttgtcttgcttctgcagaaggagagatgacgtgctgcatgacatgatggcatgtgaggcagcggcctcttctccgcaacccttgtcatggcctggagttggtgttctaggaaggggcacaattttattagggtagccaccagagttgaggtcccttttcaatggacgaacttggtgctgtggacgacatctgctattgtagataggcgcatacatgttttcctataaatgctagctctgcaatcaccaaaggaaaacacaagagtactcttggaggaaagtttagcattcagtttaacaaaccttaccaactcatgccttgtttgaatgcaataatgcatgttctgttgccctgttgttgcttggacacatgcttggcatggctattttctggttatgtcacaactcacatctcccatgtaaatttatggctatgatatgcatcaaacaagcttatattttgctcttaaaaaaaaaaaatagagacacctaaatt

SEQ ID NO: 17089 - DNA, 369 bp, Zea mays
  Clone ID: LIB3279-200-Q1-K6-A5
tctttctgctccctcgcagggctcctacacgatctacatgaagattgtcggggacgacaacgaggagctgagctgcatctcgttcgggttcagcatcggcttcgtcgcgtccagctgaacgcgtccgagcctgggcacgagaggcagccagcccatggatgattctgatgaggacgagactgatgattccgatgaggacgagacagatgaaaccaattgccttttaatggtctatgttatcattcaaaattgccttatgttgacactatgtatatatgctattcacaataatagagccattcatactgttgggcgccttggatgaactatcttttcttcaacaaagatggagctcatgcagattgattt

SEQ ID NO: 17090 - DNA, 618 bp, Zea mays
  Clone ID: LIB3279-200-Q1-K6-A6
cggacgcgtgggcgccgcctgctctctgctgccgtctgcatggggagaagggctgctagatgctatcgccagatcaagaacacgccataccgcacgtacaggtactgccgaggtgtccctgaccccaagatcaggatctacgatgtgggcgtgaagagaaagggtgatgatgactttccctactgggtgcaccttgcctcttgggagaaggagaatgtctccagagaggctacagacgctgcccggattggctgcaacaagtacatgaccaactctgcaggaaaggatgccttccaccttcgggtccgggtgcaccccttccatgaccttcgtgtcaacaagatgctatactaggctggggctgatatgctccatactggaatgaggggtgcctttggcaagcctcagggcacctgtgctagggtggacattggtcaggtcctcctttctgttcgatgcaaggacaacaatgctgcacatgccagggaagctctgcgtcgcgccaagtgcaagttccctggccgccaaaagattattgagagcagacagtggggcttcaccaagttcagccgtgccgactacctgaagtgcatgagtgagggtagacttgttcctgat

SEQ ID NO: 17091 - DNA, 471 bp, Zea mays
  Clone ID: LIB3279-200-Q1-K6-A7
cccctctccactccatcgtcaaggaaggaacacggccctaactaaaccctagctaagggaagggaaacaagaccatggatgcctccaagctccgtgagcttcgcgacttcgtcgaggcgtgcaagaagaatccttcgctcctcgccgaccccaacctctacttcttgcgggattacctccagagtttgggtgccaaaattcccgtcgtcgtcccctctttcgaaagtcccaagagatctttcatggacgacattgatgacgacggtgatgacgacgacgatttggatatgagggatcccactcctgagcgagacgagcttcatgaatagattgttgagtctgatcttgagctctaaggataaattgttcagggtgtccatgatgacctattatataagatggtaaatttctttattgtaggttactgatgaaaactctttatgctttttaagtaagtatattgtttggttt

SEQ ID NO: 17092 - DNA, 485 bp, Zea mays
  Clone ID: LIB3279-200-Q1-K6-A8
gcaatttgagttttatcaagcggatggactgacaaggttcaacccatcggatcccagcaggcttctaccaagctatgtccctgaaggctcttttatcgcaagagagcacacaccgatgtccaacttattttcctgcctgtggtacaatgaagttgatcgattcacacctcgtgaccagctcagctttgcatatacatacttaaaactgagaaggacaaatcctgacagaccattccgtctcaatatgtttaaggattgtgagagacgatcaatagcgaagctattccatcacaggacagaagagagacacaacagtgcacaattaacaagatgacacatccttcctagtgatggagggcagaagagagaggttagggattgtattctttgatatagctcagctatccacaagactctccattgaaactttatgcccctgtctaggagtttgtactttatataatgcaagccttctttcctttgtc

SEQ ID NO: 17093 - DNA, 638 bp, Zea mays
  Clone ID: LIB3279-200-Q1-K6-A9
caggaacagagcgaggcgacgccgcggcacctcttctccggcgaagggaaatggcaaccgttccaggggatctgatctggcaggttgtgaggaagaacaactccttccttgtgaagcagttcggcaacggcaatgccaaggtgcagttcaccaaggagccgaacaacctctacaacatccactccttcaaacactcgggtttggcgaacaagaagactgtgacgatccagccagctgcaaaggactcggctgtggtcctctctactaccaagaccaagaagcagaacgcacctgcgaagctcagccacaagtctgtgatgcgcaaggagttccgcaagatggccaaggctgtgaaaaaccaggttagtgacaactactacaggcctgatctgaccaagccagctcttgctaggctaagctcggtgtaccgcagcctccaggttgccaagtccggtgtcaagaagaagaacaggcagtcctaagcgctaagtttgtgttctgtcagggggcatgttggtgctcgtagtcccagcttatatttatctatgttccaacagttgagacttgttagaactgagcaaaccatgttaagatgctgctgtgtgtcattccttaaaaaattgccttgcactttgtga

SEQ ID NO: 17094 - DNA, 133 bp, Zea mays
  Clone ID: LIB3279-200-Q1-K6-B1
gtcgactctagctcgacgcagcaggcgccccctagtcgccacccctgccgctgccaaggagacctcccccgccctgcaaatcatctcacgaaggaggattcgagggctgatgcaacgggattcgagggctcat

SEQ ID NO: 17095 - DNA, 616 bp, Zea mays
  Clone ID: LIB3279-200-Q1-K6-B10
cggacgcgtgggcggacgcatgggcagcaaactaccacacccatgtccacctccgtctctgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccggccccaccggctccgatgccgggtccaagaagaagctgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccggcgtacctggattcagtggactggagcaagtggcacgtcttctgggtggatgagagggtcgtgcccaaggaccatgtggatagcaactacaagctcgcctatgatgggtttctctccaaggtgccgattcctcctggacaagtttatgccataaatgatgcgttgtcagcttgaggagcggcagacgactacgaagcgt

SEQ ID NO: 17096 - DNA, 626 bp, Zea mays
  Clone ID: LIB3279-200-Q1-K6-B12
acctgtagcactgaatttgctgtcagagagagaaaaagatgaacttgtgcaattagttgatactatggtctcctattcagttacatacagaaacacaaagtttgtccctcaagaaaaggcaaacctatctgtagtgccgcatgaagtttcatcactctctctttatcctccaattaatgatgtcataaattttgagggctatcaatcagagcacattggactgtctttagccatgaaacaggttttggtgcatgaggtggagaagcaaaagatcattaaagatagcgctggcaaattgttgaaccaatctaatgatggaaatatgaagagcgaagctttatcaactataaggaagaaaacagtagctaattccatccgtccagctttacattcttccaaggatagttccaagtgcaattcatctacacttgaaatgcagtcaaactcagcctctactgtgaatgataaagattctatatctgccaaaaaacactccagccgtgcagcaaatttctttgacagatttaggaaggaaaggccagtagacggaaaaactcatagtgatgtggggctgcaaagagcaacacttcagagggattcacgccctctgatcttcaatataatga

SEQ ID NO: 17097 - DNA, 653 bp, Zea mays
  unsure (1)..(653): unsure at all n locations; Clone ID: LIB3279-200-Q1-K6-B3
cccacgcgtccgggatagcaagatgttttgattgacagatttgatggccgtgcattgcttgattttatccgagactcgagctctcgcccttttcgagtccaagggaaatctgaagaagaggaagagttagaggaatttgttaattttgaacgttaccgggatttgattaagcatcgtcgcagaggattttctgatgaggccggtttgcagcatgttgtgcaagagttggaggcaaaagctcttcttccttttagctttgacaaaccacaatcctcacagcctcctgctagcaaaggcgcatattcacaggttggatactcatacaagggagacggaaatgaggaatctgaagacctagacagtgatgacgacgacgaagaggaagaagttgatgatgatgacaaggacttcagtagtgatgatagcagtgatgaacgaatggaaagtatagcgaaagaatttgggataaaaagatataactggcttgtttacatggataaaaaaaacaaagaacaggagaagaggcagaaagaaattgttaaaggcgacccatctataaaaaaaatgagccgtagagaaagaaggaaggcttctcagattgagcgggaaaaggagncggaggcagcacgttctgttggaagggtatcttatcg

SEQ ID NO: 17098 - DNA, 569 bp, Zea mays
  Clone ID: LIB3279-200-Q1-K6-B4
gcggatcatcggagagctggccaaactgctggagaagcccaacgtggattttgacagggttgacgcctttgtgcatcagctcaaaggaagcagtgcaagtattggtgctcagaaggttaagaacacttgcattcagttccgcgaatcctgtcagcagaagagcaaagatgggtgcctcaagacactggagacagtgaagattaacttctatgacctgcgtgacaagtttcagaccatgcttcagctgcagcgtcaggtcaatggctgtccccccagcaagtgaacaagatggtggagtggagcttcatgttgggatgatgcgtgcatctttcaagttccagaacattctgaataagctcctcaattggcttctaggaagtctgtaatagcttagcagcaagattagcgttgacaccaccgtagcagaagtcaatgtcgtcgtttttgtgtcaccgtcttagtcgtaagtgtccgtgctgggtgatggatctcctgcaagcagttgcaagtggtccatttactatgtagtagtggctctgaataatctatatcttagcaatgaatttggc

SEQ ID NO: 17099 - DNA, 645 bp, Zea mays
  Clone ID: LIB3279-200-Q1-K6-B5
cccacgcgtccgcggacgcgtgggcgccggagaccgagaagcaatctctcctccccccggccagccgaccgaccgaccgaccgaccgacccatggaccgccgtcctgctctcgccgtctctccgcgccgcctccgcccgcgcccgccccgggtgccccgcccgcccctcgtgccagcctcctccgtgcaaacgcctccaggatcgatgaagaaggcggcggctccgatgcgcgcgtccgtctgcgcgatcccgtcgccggtccgcttcgagcccagcccgatgcgcgcctccatctccgctctcccgtcgccgatccgcgccgaaccgagccctatgcgcgcgcgcgtgaccgccgcgctccagccaccaagtcgcgtcaagctcgacctggctgcgtcgtcgcctcctccggcaagggcggcggccgacaaggagaacttcctcctcgccgcggctccgtcgtccccctcggcgagggtggggttcgacaaggagaacctcctcccggccggcgcggacgcccacgacgagcttgtggcgctcaacctcgccgcgattgccaggacagcgggcacgccgtctggtggcccgctcttcgtgcggggcagactctacgacctctactcggcgcgccgcaacgagcg

SEQ ID NO: 17100 - DNA, 586 bp, Zea mays
  unsure (1)..(586): unsure at all n locations; Clone ID: LIB3279-200-Q1-K6-B6
gaagaaaagaagagagcgggactctgacacaactaggccagataaatataggtttgaaggtactattgcaggatttgaaaaactaagcaagggaaccgagccaacaaaatctttatatttgaagaaggaactgtgggaagatgaaaaggataagataggcaactttgtctcctcagccaacaccgacaaggtcaaagaatctccggtcaaacatgttttgccctccactggtatggctgctcatgctttagacgatctgtttgaagctgttgaactggaggatagacgtgacacatcaatagaaaatgatgctgatgacgaaactaggtcgcctgttatgcccccacaaccaccaccggtggttaatacttacgagcagtacgaggctgatgatgaggaagtcgacgtggaataagtagaatgccgagatggtactggaatgagctatatagctctcgcgcctgtgtaaagcattatgtaatatgtatttgatgctggagtttaccttgcatacaaagaatcgtcattaatgatccttggtggatgcggtttaagcactcanaananaaaaaannnnannnaannn

SEQ ID NO: 17101 - DNA, 641 bp, Zea mays
  Clone ID: LIB3279-200-Q1-K6-B7
ccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgagcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgaccttaaggaaaacgtaccagagcagccttggtaataagaggatcgaactattcgatacgggtaatgaccaggtggctgagggaactccagttcaaatggcatcagaaatgtcaaatcaagaactcattagcaccggaaggaaacaaatggaccaaactgatcaagctattgagcgctcaaaatggttgtagcacaaactgttgaagttggagctcagactgctgcaactctgacacagcaaacggaac

SEQ ID NO: 17102 - DNA, 79 bp, Zea mays
  Clone ID: LIB3279-200-Q1-K6-B8
cccacgcgtccgcccacgcgtccgttttgttgtattaagtcttcttgttagcccattaaacgatgagatcgtatacttg

SEQ ID NO: 17103 - DNA, 630 bp, Zea mays
  unsure (1)..(630): unsure at all n locations; Clone ID: LIB3279-200-Q1-K6-B9
gcttcctgtgggtgctccgtggcccgccaccgccggacggttccaagtacccgacggacgccaacgtccacgagctgctcccggaagggttcctggagaggacgaagggccgaggcctcgtgtggcccacgtgggcgccgcagaaggacatcctcgccaaccccgccgtcggcggcttcgtcacccactgcggctggaactccatcctcgagagcctgtggcacggcgtgccgatggtgccctggccgcagttcgcggagcagcacctgaacgcgttcgagctcgtgtccgtcatgggcgtcgccgttgccatgcaggtggacaggaagcgcggcaacttcgtcgaggcggcggagctggagcgcgcggtccggtgcctgatgggcgggtcggaggaggaggggaggaaggcgcgggagaaggcgacggaggcgaaggccctgagccagaacggcgtggccagcggcgggtcgtcggacgcgtcggtgcagaaactggcgcgagagattttgcacaagcacgacgacaagggggtgtgccaccgcaagcggggagagcatgggcagcgtcgtcgttcccgcatctncggccgggataatatgatcccccgacacggagaaatcgncgtcg

SEQ ID NO: 17104 - DNA, 635 bp, Zea mays
  Clone ID: LIB3279-200-Q1-K6-C1
gcgtgcgaaccaagcagaccacaacaagaagaagcgtagtcgtcgccggaaggaaaggcgcggagcaagatgtcgtggcaggcgtacgtcgacgagcacctgatgtgcgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgttgggggcagtgttggggacggatttggattggggtttatg

SEQ ID NO: 17105 - DNA, 615 bp, Zea mays
  Clone ID: LIB3279-217-Q6-K1-A2
cccagcgtccgctcaaaactgttaacccaatcctttcctatatttagctccccttttactctttaattgagctatttgatttttctacattattttttatcaaagtaacactaatatagggatatgtaaaattcttgctacgaagatataaaattagtgttatagtgatattttgtcatacggatttacatattgtagtgatgtttagtatttcgtatctatgttttattcgaatttataactctcgtagcaacgcacgggcacatacctagtatatatatatacacacactatgtgtgtgtgtatagtcatgaatttactactattttttattaagtcaaatatagaaaatcctaaattcataacaatacaaatgtatactagtagacagtttctttgttattagtggtttcattgccgcgttgaagccaggtgcatcttacgggttcaactataagatgtgacatgctaaaatgatcctatatggttggcggggaaaattcggacattttactcctgatgagaagaaagcttttgaggttaccgatagcctatctggaggcaccctgatcagcgctcttgctgagaaaatatggacggacatacacaactgtt

SEQ ID NO: 17106 - DNA, 619 bp, Zea mays
  unsure (1)..(619): unsure at all n locations; Clone ID: LIB3279-217-Q6-K1-A3
cgnagacttcgacttcggggccccggnagggcacggcatcttcgaagcgctcggggagctcctcatcgactctgggtgcgtctctgaccaggagcactgccttcaggtctgcagtaagctttgtgaaagtttggaaagcatggtctggtgaaaccgaaacaagctatgcgcagccttgtcacaccattacgaatgaatgcggggatggacgatgatgtcgctcccaaaaagccgcagcctgaagtattcgatggaccactgctgtcttcgcgcgataaagccaagattgaacggagaaaaagaaaagaggagaggcaaagagaggttcaatatcaaatgcatgttgcggagatggagacacttagggctggaatgcctcctgtttatgtaaaccacagtaatgatggtgggccagctgttagggatatacatatggagaacttcagtgtcactgttggtggtcgtgatctaattcaagaagccactataacacttgcttttgggaggcactatggacttgttggaagaaacgggactgggaagacatcttttctcagagcgatggcattgcatgcaattgatggtattcctaagaactgccagatattgcatgttgagc

SEQ ID NO: 17107 - DNA, 625 bp, Zea mays
  unsure (1)..(625): unsure at all n locations; Clone ID: LIB3279-217-Q6-K1-A4
ccccgcgtccgcaggnaacatcgtgaactgtggtgctgcttccacagcggcgactgccggcttctggtgtacgagtacatggccaacggcagcctcggcgacctcctccacggcggcaagggaggcctcctggactggccggcgcggcaccggatcatggtcgatgccgcggagggcctcgcgtacctgcaccacgactgcgggccaccgatcgtgcaccgcgacgtcaagtccaacaacatcctcctcgacgcccagctcggcgccaaggtcgccgactttggcgtcgccagggtcatcggcgacgggccggccgccgtcactgccatcgccggctcctgtggctacatcgctcccgagtactcgtacaccctgcgcgtcacggagaagagcgacgtgtacagcttcggcgtggtgatgctggaactcgtcaccggcaagaagcccgtcggggcggagctcggggacaaggacctggtgcggtgggtgcacaccggcatcgagaaggatggcgtggactcggtgctggacccgaggctcgccggcgagtccagcagggacgacatggttagggcgctccacgtcgcgcttctctgcacgtccagcctgccgatcaaccgcccgt

SEQ ID NO: 17108 - DNA, 646 bp, Zea mays
  unsure (1)..(646): unsure at all n locations; Clone ID: LIB3279-217-Q6-K1-A5
gagagananaanananananaanananaganagagagaggagtgggagacccgcgagaggctgccgtgtagggaccgtagactcagcgactgcgaaggagggataaggggatggccgggatcggaccgatcaggcaggactgggagccggtcgttgtgcggaagaaggcacccaccgccgccgccaagaaggatgagaaggccgtcaacgccgcgcgccgcgccggtgcggagatcgataccatgaagaagtacaacgctggtacgaacaaggcggcatccagcggtacatccctcaacaccaagcgcctcgacgacgacaccgaaaacctcgcccatgagcgagttccaagtgatctgaagaagaatctcatgcaagcaaggctcgataagaagctgacacaggcacaacttgctcagatgataaatgagaagccacaggtgattcaggagtatgaatcaggcaaggcaatccccaaccagcagatcattagcaagctcgagagggccctgggaaccaagttgcgtggcaagaaatagctttcctacgagtttgtgtcccggagcatcataatagggggaagacaaggcaagctgtctgcttatttgtctatgtttggtatctcaagtcctgcggactgtttctg

SEQ ID NO: 17109 - DNA, 482 bp, Zea mays
  Clone ID: LIB3279-217-Q6-K1-A6
ggccccccgcaagcagctcgccaccaagcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccgattccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctccggggatctgatgaatgtctagttaccaaacaaataggctgtattagcgtcgttgttctgtattcgttattttggattcggttgcagtgaaaaacagctttactaa

SEQ ID NO: 17110 - DNA, 576 bp, Zea mays
  unsure (1)..(576): unsure at all n locations; Clone ID: LIB3279-217-Q6-K1-B1
aagnattgactgagnatggagaganagacagaaagaaaggagatgaaacagcaagctgatcatgatgcaggtgcaaccggtggcactgtggatgggcatggaagctctggcaatgatccaatggatgtggatgtaggatcaaatgatcagaatgtttctgcagagagaattgaagcatttgaagcacttctgggtcagcatgtgttggcaaaccatatagatcaaatgtcaattgatgaaatcgagcagatggttaatagggagtcaactgcaccttacaccagaagccaagtagagtttattttggagaggatgcaagatgcaaacagggtaatgatacgagatggtgttgttcgaatcatataactacctgtctaccaggacgtttacctgtggatcccatggtcgtgctgtgtcatggtgcctgtctctgtctgtaaccaacttatatgtcgaagtatttgtttcttagtgtttgtccacaaaggattgaggcaaccattgccccccttggtacttttagttcatgtgatgtattgcttacttacctgacctagtgatatctagtactcagtc

SEQ ID NO: 17111 - DNA, 651 bp, Zea mays
  unsure (1)..(651): unsure at all n locations; Clone ID: LIB3279-217-Q6-K1-B2
aacaggacagnaacagtacacatttgaaggccatgaagctcctgtgtattctgtatgccctcactacaaggagtccattcagtttatcttctctactgccnattgatggaaaaatcaaggcatggttgtatgattgcttgggctcaagagttgactatgatgctcctggacattggtgtactaccatggcttacagtgctgatgggacaagattattctcttgtggtactagtaaagaaggtgattcacacttggttgagtggaatgaaactgaaggggcaattaagagaacatacaatggcttcaggaaacgttcactcggtgttgttcagtttgacacaactaggaatcgcttcttggctgctggagatgaatttcttgttaaattctgggatatggataacaataacatactaacaacaacagactgtgacggtggactgccagcaagccctcgtttgagattcaatagagaaggttcattacttgcagttaccacaagtgataatggaataaaaatacttgccaacactgatggacaacgcttgcttaggatgcttgagagtagagcatttgagggctctagaggacctcctcaacaaataaacaccaagcctccaattgtcgcccttggtcctgtttcaaatgtca

SEQ ID NO: 17112 - DNA, 637 bp, Zea mays
  Clone ID: LIB3279-217-Q6-K1-B3
caaccatctaccagcgactcagcgagcgagaacagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatataaaaaaaaaaaaaaaggcggccgctc

SEQ ID NO: 17113 - DNA, 631 bp, Zea mays
  Clone ID: LIB3279-217-Q6-K1-B4
gttggtaagccccacctccggtcccagcctggccagacttctgcccttctcctccgcctctctaatggtgattcgcagttactcttctttccactgtgggttgctgatttccagagcggcgtggaggaggcactacccgttcttctgggctgtcaggccttccgtaccgccgccgccgtcgccactcccactcccacagccgcgcacgcgcttctcctcctcctcctcactgcgctccaccaagagatccgccgcaaagacgtcaatggactcgtcttcagtcggtgaacccttctacgtcgtccgcaagggggacgtcatcggcatctacaaaaccctcagcgaatgccaagctcaagtcagcaattcggttcgcgacccttctgtcaccgtcttcaaaggctactcgctgcgtaaagacaccgaggaatacctcgccgcgcgcgggttaaggaacgctctctacgccattgatgcaacagatgcacgagatgaattgttcgacgatctagttccctgccctttccagcaacctgatggagctgcatcgtctactctgaaaagacacaggagattgaaatcggaccatcaaagaagcatcccaaagttgatgagcaggtaccattacctg

SEQ ID NO: 17114 - DNA, 546 bp, Zea mays
  Clone ID: LIB3279-217-Q6-K1-B5
caccttcccaaaaaaacccccttttcttcgaggcgaggagagcgtgaaagacagggcaccggcagcgacgatgtcggggcgcggcaagggcggcaaaggtctgggcaagggcggagcaaagcgccaccgtaaggtgctccgtgacaacatccagggcatcaccaagcccgcgatccgtaggctggctcggaggggcggcgtgaagcgcatttcggggcttatctacgaggagacccgcggcgtcctcaagatcttcctcgagaacgtcatccgcgacgccgtcacctacaccgagcacgcacgccgcaagactgttaccgccatggacgtcgtctacgcgctcaagcgccagggccgaaccctctacggcttcggaggctaggctggatgcctcttctccttgctgtcgtggatgcctgtttgttgttagggttatttcgtttagttccttgtctgtgacgtgttggactattgttagtagtattcttgaagttgtttcgaatgtaatccaatcttatcgttcgataattgaaatgattcctgggc

SEQ ID NO: 17115 - DNA, 631 bp, Zea mays
  unsure (1)..(631): unsure at all n locations; Clone ID: LIB3279-217-Q6-K1-B6
gttctagnacgcgagtggccgcccgcgatctagacggacgcgtggggcagcaacagcctgcagccggcagtcctcgcctccgcctcctccaccctgaccgtcaacagaggaagacgaggatgtcgggatccaaggtgtacaccctcgaggaggtggctaagcacaacaccaaggacgactgctggctcgtcatcggcggcaaggtgtacaatgtgaccaagtttctggaggatcaccctggaggcgatgatgttctgctgtcttccactgccaaggatgctaccgatgatttcgaagatgtggggcacagcagcactgcccgtgcaatgatggacgagtacttagtgggtgagattgatgcagccacgatacccaccaaggtgaagtacacgccccccaagcagccgcattacaaccaggacaagacccaggagttcgtcatcaagatcctccagtttttggtccccctcgcaatactgggtctggccgtcgctgtaaggatgtacaccaagtcggaatctgcctagtctcttgtcatcaacgctgcaaacataacatcatccacaaactgaataagttagtgttaaaatgctgcaaagatcattaattctgaaacttgagtctttgctgt

SEQ ID NO: 17116 - DNA, 329 bp, Zea mays
  unsure (1)..(329): unsure at all n locations; Clone ID: LIB3279-217-Q6-K1-C1
tggnaaattgggctgtttcctctttattgaagggaaaaaaggaggttatggacaagtaaatgaatttttttggtcgcctgtgtatcctgttagattctgttgtaacttgaatagccggaatttctatttgctctcgcgttcgtcgaaccatactccctgaatgcgctgccgttgctacagttgttggccaactttctttgacacaacgctgtagtactccctgtcccaaaaaaataggacagatattttttttgagatgtcttttgaagcgaaactttgacgataatttatttttaaaatatgatatcaacaaatgcaaattaagcatc

SEQ ID NO: 17117 - DNA, 612 bp, Zea mays
  unsure (1)..(612): unsure at all n locations; Clone ID: LIB3279-217-Q6-K1-C4
ccccgcgtccgcccacgcgtccggnaagtagcgggcgcggaggaagaggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggtttcaatgttgaaactgttgagtacaagaacattagcttcacggtctgggatgtcgggggtcaggacaagatcagacctctctggaggcattacttccagaacacacagggtcttatctttgttgtggatagcaatgaccgtgaccgtgttgttgaagccagagatgagctgcacaggatgctgaacgaggatgagctacgtgatgctgtgctgcttgttttcgccaacaagcaagatcttcctaatgccatgaatgctgctgagatcactgacaagcttggattacactccctgcggcagcgacactggtacatccagagcacttgtgccacaactggcgagggtctgtacgagggcctggactggctgtccagcaacattgcgagcaaggcttgaatatcaaatgcgaactgacta

SEQ ID NO: 17118 - DNA, 637 bp, Zea mays
  unsure (1)..(637): unsure at all n locations; Clone ID: LIB3279-217-Q6-K1-C5
gcgaacagnagcactgaacagagcgagcgagctgtccggccaaaccctcacggccgcctccacaatgccgcgccatctcgcgctgctcctgcccctgctactgctggcctcgccggcggccacgcgcctggcgtccgccgcctgcgcgggcgagaagttcccggcggggcgtgcgtacgcgtcgtgcgaggacctgccgaagctgggcgcgtcgctgcactggacgtacgacgcgtccaagagctccctgtcggtggcgttcgtggcggcgcccgcggcggcgggcggatgggtggcgtggggcctgaacccgacgggcgagggcatggccggcgcgcaggcgctggtggcgctggcgggggccggggccgcggcgcccgccgtgcggacgtacaacatcacggggtacgtcccgctgggcaaggcctccacgccgctggacttcccggcgaccgacctcgccgcggacgccgcgggcggcaagatccgggtgtacggcaagctgcagctgcgcaaggggatgaaggccgtgaaccaggtgtggcaggtcggcgcgtcctccacgggcggcgcccccgacaagcacgcgttccaggcggacaacctcggcgccaagagcaagctcgtactcgccgga

SEQ ID NO: 17119 - DNA, 636 bp, Zea mays
  Clone ID: LIB3279-217-Q6-K1-C6
cccagcgtccgcccagcgtccgattttggggaacgggaatatatagggatccaaataagcaaatttgtcatccctacgcacccactgaaatcccttcaccaagtcgaggaccccctccgaatccgagggttcaagcgaccgacggcgaacatggcggcggacggcggcccagcgacgtcggcgctggaagaggccctcaagcccttccaggaaagagcctccgaggctgagatacgcatagcgaagctggaagccttgctgtacaacaaagatggtccgagcggtggatccgaggcaacttcctctgccgtgaaggatctccagtcgaagctagatgtggttactgcagaatgcttgactgaaaaggagaagaacaagaagctgaccatggagaacgagaagctccagtaccgcatgacccatctgatccgtgcgataaaagaggcggaatcgagataggagcagcccggcgaggccgattcaaagcctgatgtcgaagtgttcccacccgccttgctgatccttcacgttgttcctgcatctacctcaagctaccattgtgatcttgagttagagcttggtcacaagtcaagactgtattatcgaactgtcgattgaagtgatgatgtgtgcaca

SEQ ID NO: 17120 - DNA, 601 bp, Zea mays
  Clone ID: LIB3279-217-Q6-K1-D1
gttggcatttgatatgggacacgtgtagctattgttgggcccaatggagctgggaagtctacgctgcttaatttacttgcgggtgatcttatcccaacagaaggggaggcaaggaggagccagaagctgagaattggacgatactcgcagcattttgttgacttgctgacaatggaggaaaatgcagttcagtatttgttgaggctccacccagatcaggagggaatgagcaaagcagaggctgtccgtgctaagctcgggaagtttgggttacctggacacaaccatctcactccaattgttaaattatctggcgggcagaaggcccgagttgtgttcacttctatatcaatgtctcaacctcacatactcctgcttgacgagccaacgaatcacttggacatgcaaagtatcgatgcattggcagacgcgctggatgaattcactggaggtgtcgtcttggttagccatgactcacgattaatatctcgtgtttgtgaggatgagcaaaggagcgagatatgggttgtggaggatgggactgtgaacagatatgatggcacgtttgaggattacaaggatgaactcatggaagaaataa

SEQ ID NO: 17121 - DNA, 640 bp, Zea mays
  unsure (1)..(640): unsure at all n locations; Clone ID: LIB3279-217-Q6-K1-D2
ncccacgcgtccgaccccacacanaagcggcggcggcggagcaaacgcaggcgaaggcgagggtgtgagggaaggagcaccagccatggtgcacgtcaacttctaccgcaactatggtaagacgttcaagaaaccaaggcgtccttatgagaaggagcgtcttgatgctgaactgaagctggttggtgagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgagggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaattgtcaacgtcccatcattcatggtgagggtggagtctgagaagcacattgacttttcactgtcaagcccattcggtggaggccccgcagaaagggtgaagagaaagaatcagaagaagcaagcggtggcg

SEQ ID NO: 17122 - DNA, 632 bp, Zea mays
  unsure (1)..(632): unsure at all n locations; Clone ID: LIB3279-217-Q6-K1-D3
ccanaagtgagnaanaagatagagagagagagagtgatcggtacaaggatcaccgctgtgcctgcgcgtgctgcttcaccgaatcgagtcagaccctgtccgaatccgagccaagggatggcaaccggtagtgaggcctcgaaggcagctgaggctgtggttgactggcataaacaggacagcaagaggatgctccatgcggtttaccgtgttggggatctggaccgtacaatcaagtactacacggaatgctttgggatgaaactgctgaggaaaagggatgttcctgatgagaagtacaccaacgccttccttggctttgggccagagaacaccaactttgcagttgaattgacatacaactatggcgttgacaagtatgatattggaacgggctttgggcatttcgcaattgctaatgatgatgtgtacaagttagctgagaatatcaaatccaagggtggcaagatcacccgcgaacctggtcctgtcaagggaggatccactgttattgccttcgcacaggatcctgatggctacatgtttgagcttatccagagggccgacacacctgagcctctttgccaggtcatgcttcgtgttggtgaccttgagcgttctatcaagtttta

SEQ ID NO: 17123 - DNA, 611 bp, Zea mays
  Clone ID: LIB3279-217-Q6-K1-D4
gccactccaaaacttgcgccgccctgcctcaaggtaaggccgccatggtctccggttcgggcgtgtgcgcgaagcgcatcgtggtggacgcgcgccaccacatgctgggccgtctctcctcgatcatagccaaggagctgctcaatgggcagaaggtggtcgtcgtccgctgcgaggagatctgcatgtcgggcggcctcgtccgtcagaagatgaagtacctccgcttcctccgcaagcggatgaacaccaagccgtcccacgggcccatccacttccgcgcccccgccaagatcctgtggcgcaccatccgcgggatgattccgcacaagaccaagaggggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaagcag

SEQ ID NO: 17124 - DNA, 634 bp, Zea mays
  Clone ID: LIB3279-217-Q6-K1-D5
aagaaggcctcctgtctcctctcacttcctcagtcctcgtccgtctctgctccctcctctctctacctagctagctagccagccttcctgtagcgcggcagagatggctgcccctgcatccaccacggcggcggcggcggcggcgctgctgcttctgctcgtgtcgctcgccgcggcggcggacatgtcgatcgtgtcctacggggagcgcagcgacgaggaggcgcggcggatgtacgcggagtggatggcggcgcacggccggacctacaacgccgtcggcgaggaggagcggcggtaccaggtgttccgggacaacctccgctacatcgacgcgcacaacgccgccgccgacgcgggcgtccactccttccgcctcggcctcaaccgcttcgccgacctcaccaacgacgagtaccgcgccacctacctcggcgccaggaccaggccgcagagggagaggaagctcggcgccaggtaccacgccgccgacaacgaggacctgccggagtccgtcgactggagggccaagggcgccgtcgccgaggtcaaggaccagggcagctgcgggagctgttgggctttctcaacaatagcagctgtggaaggcatcaaccagattgttacaggcgac

SEQ ID NO: 17125 - DNA, 592 bp, Zea mays
  unsure (1)..(592): unsure at all n locations; Clone ID: LIB3279-217-Q6-K1-E1
ccaaaaggcctccaaaacanaagctgttcaaccttaacaagnatgatgatgtacgcaagtacgtgaacacataccgcaggacattcactaccaagaacggcaagaaggtcagcaaggcacctaagatccaacggcttgtgacacccttgaccctccagaggaagcgtgctagaatcgctgacaagaagaagaggataactaagaagaagtctgaggctgctgagtaccagaagcttcttgcccagaggctgaaggaacagagggaccgccggagcgagagcttggccaagaggaggtccaagctttctgccgccgtcaaggcttctgctgccacctctgcttaagaatattcagtgttttgggatctttgtaaggtctatctcgttacagcgaaagtgcctctctacttagatttatgagtaattgttgcttttttgtatgaacatggtaatggcttgtcggagtaccagaggtttactatgttggtttatgctgtgaacgtaagcgagccatattctttggtatgcagtctgaactatatgttaacgtttgggatttttgttaacatgaagtatcctgcttggttgccttg

SEQ ID NO: 17126 - DNA, 636 bp, Zea mays
  Clone ID: LIB3279-217-Q6-K1-E2
cccgggctcgcttttccttgcaccgttgccttccccctcccaccaagaccgtggcgcccaagccgagaagaagcccgcggcgaagaagccggtggaggaggagcccgcggccgagaagacgaccgccgggaagaacccaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgccaagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttgtt

SEQ ID NO: 17127 - DNA, 485 bp, Zea mays
  unsure (1)..(485): unsure at all n locations; Clone ID: LIB3279-217-Q6-K1-E3
ctgtcctccctgcgccggnttaccactgaccacttcacagtcacagtagtacagagcggcagagtggagaagtagactctaggtgagatggcggccgtggtggcggcggtggaggcaggggtggtggcggtggcaagcgggaggggatgcagcagccggctggtgcggggcctgtactggcgccttcgcgcggttctgcggcggctgcggtcggagcgggccaggcgcggccggaggttcagcttccactacgacgcgctcagctacgcgctcaacttcgacgacggccgcgccgcccccgccccggcccccgccgcggccgacctcgtccttgcccccggcgacaacgacgcgctacggtgaatcggcgtccgacgatccgctgccaagagccagctggggtctctcttccttgctccggacgccgctgccttttccactctcctgtggtttcgctttttcgataaatgggggttgtgtaatgg

SEQ ID NO: 17128 - DNA, 633 bp, Zea mays
  Clone ID: LIB3279-217-Q6-K1-E4
gtaaattatatctcatgtctatcaacgaagttttactttttaggttctattaatgtctaattcttgtaacccctcttttttggtatctcaattgttgcagttaggaaaccttccattacggccttatttctgcagaagtatgacaccaactttcatctattctctaccaccaaagagatggaaaagcaggttgcccccacccccatagctttctgttttgtccctataacaggtttacctatgttatatatagacaccgtagcaatgcacgtgtaatggtagattttctgattggttagtttggaagtgaagtaggtgccaatgttgtgcatgagcagaagaaatattattcccttcaatattagtagaggtagagatatttacttttatcagtatttgtgttgtgatagctatttttagcctaatgtttcaggtcaaagggccatacttcatagctttttgctcctcattgttttaagtgaaagggcgccaactattcaaaatttactctaggtagataattttcattgtcgagttttattttggtatatgtaactttttgtaattgggcctaagcgtattggagcactctaagttaacaggtgcttgaagctgatgatgaaattatacagc

SEQ ID NO: 17129 - DNA, 206 bp, Zea mays
  unsure (1)..(206): unsure at all n locations; Clone ID: LIB3279-217-Q6-K1-E5
cagnatccaacttattgccaaaccaattgtttgggaaagtaaatcctgacaaaaggaaggttagccacggagcggccaaaccttcgtcatcaaaggtctcatctaggagttgggcacagttacacacatttattcatacacttttctttaccagctgtactatactattaattttatttatttacatcagtcaatgcaccaaggcc

SEQ ID NO: 17130 - DNA, 309 bp, Zea mays
  unsure (1)..(309): unsure at all n locations; Clone ID: LIB3279-217-Q6-K1-F1
ngacagttgngatttggggatgcaagnactgtgggaaggtcaaggctggcggtgcttacaccatgaacactgctagtgcagtcactgtcaggagcacgattcgtcgcttgagagagcagactgaagcatgatttagcttgctacatcagggttctcctagttgctgttgtcgggaatgttgagctcctctagttggatcacgagactggctaaaagttgggtgctaagatttgtagttggttaccgttgtgaatttctcaagtgatattatcctatgcttgtctcaatgactcaaatttggttgtggtt

SEQ ID NO: 17131 - DNA, 635 bp, Zea mays
  Clone ID: LIB3279-217-Q6-K1-F2
gcgcgcttgccgcccgtgtctgctggctcgggtcccgtgtcctcgttcctcccgcctccgaagcactcgctcgggctcggcgccggctctggcgcgggagcgaggaggtcggcaatcgatacggctgcgccggagaagccaaatctcggcaccgctctgccttcaagctcggttgccaacacaggagccccggaaaggcctgacaccggcgcaaccgacgaggacgattcggaggatagtggcagtgagggtgacatgcctgcgccggagctggaggatgagcatgaaaaccagcaggcttttaatgccgcaaccggggagcagcagcaaagctatgatgctggagccgggagcactagtggatatgaaacatatgcgtgggatccaaaccactatgcacaatatgatgcttatggttgggatcctagtgccagtgcgaattatgaggatggaacacagtatgccgcatatgaaagagggcaaagtgcagggtatgttcatgcacatggaggggagcatgccagtggatatgaccatgttgcggcagtgccatatcgagtagattatactgctggaggttatggtcatgaggtagcagcgacattgccaccggtgcatgaaccgatactgccacc

SEQ ID NO: 17132 - DNA, 635 bp, Zea mays
  unsure (1)..(635): unsure at all n locations; Clone ID: LIB3279-217-Q6-K1-F3
cgnaccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaaactatctgaacatcaagggtctgctcgacctgacctgtcagactgttgctgacatgatcaagggcaagacaccagaagagattcgcaagaccttcaatatcaagaatgacttcacccctgaggaggaagaggagatccgcagggagaaccagtgggccttcgagtaaggaggtgctggatctattgatgcctaagtttggtggtgtctactactatgtctacttta

SEQ ID NO: 17133 - DNA, 640 bp, Zea mays
  Clone ID: LIB3279-217-Q6-K1-F4
cggacgcgtgggcaagctagctaggactagccaagccgcggcgtgcctccgctccggccggcccgcccctgtcagagcccccaccgccgctgccacctccgccagccgtcaccccatgcgttggatcggggccctctcgatccgcgcccggggatatccagacggacccgcattggggttggggccccttcgatccggcgcttggtgggggtttggctgggagctccaggctgaggggacggggcggggggacctgatccttcattccgttcggatttcgcttttcccccgtggggtctcgactgccggagggggaggaggacatggatttggcgtcagtcaacgaggagctggccgagatcgacgggcagatcggcgatatccttcgcgtattgcaaaatgggttccagaagctggagaagatcaaggatgccaaccggcgcagcaggcagcttgaagagcttactgataagatgcgagactgcaagagactcatcaaagacttcgagcgagttagcaaagctgaggctgagcatactgatccagcaacagcaaaaatgttgcatgacagaaagcagtcgatgatcaaagaattaaactcctacgttgctctaaagaaacacaggcaagtgaaaacaaa

SEQ ID NO: 17134 - DNA, 628 bp, Zea mays
  unsure (1)..(628): unsure at all n locations; Clone ID: LIB3279-217-Q6-K1-F5
cggccgcgtgggcggacgcgtgggcggacgcgtgggcgctgagcttctggaccttgagacaaaacatcaggtcctatcaatgtatctatggttgtcacatcattttgaggaagataactttcctcatgtgcagcaggctgaaaacatggcaataaatattgctgatttacttggcaagtcgcttgcgaaagcatgctggaagcctgaatcaagacagcaagttagggggcgacgagaaggaaaggatgagtacaatgaggaacaagcatcaaatgaaagtgcaaatgatgttcctacaaatggttatgaacggccaagggcacttgataaaacactaaggaaatggcaagataaggtcagccagaactgtcctccgtccttgaactttgtggcctgaaactctcatggagtgattaaacccaaatggatgctatgaaaataccctcttgcaccaagttggacaactagatcaaactgcaaacgcctcgaaagtttgtgttaatgctatggcatgttctggccattttctcatatttgacttaagctagttttgtctatctgtttggagcttgtgcttgtcatcctagaaagaattgttatcgcctaacacaccagngctgtaggtacc

SEQ ID NO: 17135 - DNA, 167 bp, Zea mays
  Clone ID: LIB3279-217-Q6-K1-F6
caatgcaataggaatatcttagtggagccaactaccaagtttgttgtagctgatgtgctgtatggctgcagagtggcagtgccatgctatcattggggctcgaaatgtttgtgataggttttgtgacttcgttctgcttagcccctctaatatatctcgagatacct

SEQ ID NO: 17136 - DNA, 639 bp, Zea mays
  Clone ID: LIB3279-217-Q6-K1-G1
gtgcctcactcgatccagggcctcgccgtagcacacaccaggccggcggcgccgatgggcatgaagctggacatgtccgcgctcgacccaacttcgccaacctgaccgcctccgtcggcgacgacacgtacttctccgccgggcccccgacgtgccgtgcatggtggctccccatctgcgacgacttacgacggccttgccagtgcgggccagccaatggatatgggtgacagaataagtagggggcacgagccagcgctatgcctgtcagtctttgacaagggacgtcattcgtcgaccgctcgattccagggccagcatgggcggttatatatcctcacacaccgcgaggaaaattattgaaataaatccttacatgctggggacaatggctagaggtgctgctgatggccaattttggcatatgaacctacgaaccaagtgtcatctccatgagctttcaaacaagcgaaggaacgctattgctggtgcttccaaactgttggctaacatactttatacatatagcgggatgggactgtcgatcggtacaatgatcgctggatgggatgagaagggtactggcttgtactatgctgacagtgatggtgcgcggctcatggggaacaggatctctgt

SEQ ID NO: 17137 - DNA, 400 bp, Zea mays
  unsure (1)..(400): unsure at all n locations; Clone ID: LIB3279-217-Q6-K1-G3
ccactactcanagtgttatgagaatgtttgggtcaatttggaatgagtggtatncaggaaaacaaatgtggcaataaggcatcctcatatctgaggagaaatgttgcgtggtgcgtgcatgaaatatatcacgcaagatcgcttggtggttcataacgaaaggttaagcgccaagattcacattttctcccataataacatcatctgcctgcatcgaagagtgaatcttcacgtgtgggtgcatgataacttcatgtggatttaaacatttctatttgtcgctgcataataaaacatgataggaatgtgtgtacacatgtgtagtgataagcatgacatgatttccgggatccaaagatctttgaggtgaatatgtcaccgaagacaataatttatcgat

SEQ ID NO: 17138 - DNA, 625 bp, Zea mays
  Clone ID: LIB3279-217-Q6-K1-G4
ctcacaatggcggcaacggcataccccatgtggtgctcatcccactatgcgtcccaggccacctcgcgtccatgatcgaagccggcaagcggctgctcggcagaagccgctgccccatgtccctcaccgtgctcatcacgcagatgaccatgtccgccaacctgatgtccgacgtcgacgacatcatgcgacgggaagccgactccggcctggacatccgcttcgtccacctccccgccgtggagctccccaccgtccaccacggcctcgaggacttcatgatgcgcttcatacagctccacgcgacgcacgtcaaggaggccgtctccggcatgtcgtccccggtcgccgcggtcgtggtggactacttctgcaccaccctgttcgacgtcgcgcgcgagctcgcgctgccggcgtacgcctacatgccgtccggcgcgtcgatggtcgcgctcatgctgcggttaccggcgctggacggggaggtgtccggggacttcgaggcgatggaaggaacggtcgatctaccagggatgccgccggtgccggctcgtctcatgccgtctccgctgatgaggaaggacccgaacttcgcgtggctggtgtaccatggcaaccgcttcat

SEQ ID NO: 17139 - DNA, 648 bp, Zea mays
  Clone ID: LIB3279-217-Q6-K1-G5
cttacgtccctagccatcctccgccgcctccgtctctgcttccctagagccgtcgcgatggcagcagcccctgccggtgcccctgcaatcaccgcatcctcctcctttgtttcttcgtctccgttctgtctcaaggcatcgatgaccagccagcgccgacccgcggggagagtctcctcgtcatccgctgcgtcagtagcccgccggccgtcgacacatctttcaagactaatgtcccgcgcaatgctaatatggccaaactccaagcaggatatttgtttcctgagattgccaggagaagagccgctcatttgctgaagtttccagatgccaaaattataagccttggaataggcgacactaccgagcccattccaaatgtcataacaaatgccatggcagagagagcacatgccttgtcaacaattgatggctacagcggttatggagctgagcaaggtgaaaagaaactcagagcagcaattgctgcaacctactatgcggaccttggtattgaagattcagacatatttgtctctgatggtgccaaatgtgacatatctcgcttgcaggtcctttttggatctaatgtgacaattgcggtccaagatccatcataccctgcatatgttgattcaagtgttatca

SEQ ID NO: 17140 - DNA, 640 bp, Zea mays
  unsure (1)..(640): unsure at all n locations; Clone ID: LIB3279-217-Q6-K1-G6
ttgcggatgaaaactgcccttgcagaagcatttctccttgcagatgatgtccttcgtcagggtgttcaaggaatatcagacatcatcacaataccgggacttgtcaatgttgattttgctgatgtaaaagctgntcatgaaaaactctggaactgccatgctcggtgttggtgtttcttccagcaaaaatcgggcccaagaagctgctgaacaggcaacacttgctcctttgattggatcatccatcgaggcagctactggcgttgtgtataatattactggtgggaaggacatcactttgcaagaagtgaacaaggtgtcccagattgtgacaagcctagctgacccatctgcgaacataattttcggtgctgtcgttgatgaccgttacactggtgagatacatgtgacaatcattgcgacaggatttccacagtccttccagaaatcccttttggcggatccaaagggagcacgtatagtggaatccaaagagaaagcagcaaccctcgcccataaagcagcagcagctgcagttcaaccggtccctgcttctgcttggtctcgaagactcttctcctgagaagctcatttggtgaaccgtgactcgtagtgcattagatttgcatttagcgtgttg

SEQ ID NO: 17141 - DNA, 349 bp, Zea mays
  Clone ID: LIB3279-217-Q6-K1-H1
aaagtgctaagtgaactcactctacagtacacatcccgatgaagattcccaacgctgaatcttgaatgagcagccagaagttctgctgtgtatatgctcgtagtttgtatgcgagaattcttcctgtatcagtttttcagaaacgatttgccttgggcatatatatatagcaaaaccggcaatgtggccagcagccaagtggagacaccgtttcaaattgattgaactatggcgaatactgattgacagaagggttagggcatgcttggtacctttaccaggtactattctacctggccgagcaaattgattaaggccaactgtttggatccaatttaggccttctttg

SEQ ID NO: 17142 - DNA, 478 bp, Zea mays
  Clone ID: LIB3279-217-Q6-K1-H2
cggccgcgtggggtcctgtcttctttactgatagagagaaaacaatctggcagacccagtgggtgtccaggaaaagaggcttcgttacgttccacatttggcatcgtctgcgatatttctcattctatcaagaattcgctaattacaaaacaggagcttttccataatattcttgccaacaacttggagatagaacagatgggagagatagaagagcagctacatattttagaggatctggctcccgattggatatctaaggtgataaatggaggagaaatattttacagctttgaaactatagcagatcagaattcagtgtgggaaaggcttgtagaagctgtgtgaggtgtggaatagctgggattggtttaaagctaaagaatcagccacatagtactatgtatgtaacgctaacggaacccatcaaacagccacattttctcataatggaatcctcaggattgctcttgtctta

SEQ ID NO: 17143 - DNA, 622 bp, Zea mays
  unsure (1)..(622): unsure at all n locations; Clone ID: LIB3279-217-Q6-K1-H3
ccccgcgtccgccccgcgtccgtagnacgcgacggccgccctttttttttttttttttttttttttttttttgcagcaccaagaagcaccatttttttccttaggatttaacttagaataaagcctgacgggggtaacagcacccatcgatccgcagtccatgctggttgatgcatgggtctgctggagccgaggatgaacacagcactaacaactgacacagagcgaccttcaatcaaaaacacagatgggcaacaacaaacacgagacgaacgaagataaacactctggactagggtaaacaacacggtagcgaacaggataacttggccgcgcgggccccaccgctcagttcctccagttcccgtcggagttgccgtagccgccgccacggttgccaccgccgtagccgccgccaccaccaccgtagccgccgccgccaccaccgtagccgccgccaccgccgtagccgccgccgccatcacggggcccgccaccgccgtagccgccgcctccacggccaccaccgtacccgccgccgccgccgcctccacggncgccgcgggactgggcctcgttgacggtgatgttgcggccgtccagctccttgccgttcatgccc

SEQ ID NO: 17144 - DNA, 639 bp, Zea mays
  unsure (1)..(639): unsure at all n locations; Clone ID: LIB3279-217-Q6-K1-H4
gcctgcatctccaagnacaagtccatgagnaactactgcagctacgcctgcgacaagacctgcgcgcccgacgcccggcagcggcgccccgcggtcgtccccatgaactgccagctcgcctgcgtcagggagtcctgccaccgtcgccgcgcggctgatggcgacgacgacacgaagacgaaggcctgctacgggcagtgctacgacgaccgcggctgcgagaccagtgccgccctgccgaggcctctgcgcgcaggcggcgttgctggcgttgtcgggcggccagcggagtcaccggaccacccattccacgagaggcaggacgctcacggaccggcggcggcgtcgcccgaccatccattccacgtgaagcagaagcaggacgctctcggcccggcggcggcggcgtcgcctggccacccgttccacaagatgcacggcgcggtcaagccggcaggggagccggatccaggatacgtcgtgtatccggcatggggccccgccgtccactaatcgtcgttcgacggcgacgacgctccgccgccaacgacggcgagtgccacatgcctatgctctcgtgtgggccccgtacgttattgagcgctactagtactagggaaagtgtacgtgtgatgtgtg

SEQ ID NO: 17145 - DNA, 638 bp, Zea mays
  Clone ID: LIB3279-217-Q6-K1-H6
ccccgcgtccgcggccgcgtgggtcacgccgccgccgccgccgccgccgccgtcgccgccaccacatccgtagcgcccagccgccggagaagaggagggagccagcaccagccaccatgggtcgcgtccgcaccaagaccgtgaagaagacctccaggcaggtgatcgagaagtactactcccgcatgaccctcgacttccacaccaacaagaaggtgctggaagaggtctcgatcctcccctcgaagcgcctccgtaacaaggttgccggcttcaccacccacctgatgcgccgcatccagcggggcccagtccgtggcatctcgctcaagctgcaggaggaggagcgggagcgccggatggacttcgtcccggagaagtcagcgctcgaggtcgaagagatccgcgtcgacaaggagaccatggagatgctcgcggcactcggcatggccgatctcccgggcgtagagcgccaggctgaggtctccagcgtccccgcctacggccgcccgcagtacggaggtccccgccgtgaccgcgtctaggtttaccgccgatcgcagtggttgcgtcgtggtcgcaccgttactcacagttgttatgttactatgttaaacttgttttagatctgtggtttc

SEQ ID NO: 17146 - DNA, 638 bp, Zea mays
  unsure (1)..(638): unsure at all n locations; Clone ID: LIB3279-218-Q6-K1-A2
ngatagatgaaacgatattgtgattctctcatggtggcttcatgagcaagcaatcattcaccttgttcactaaaatttcagactgtagctcagataaggctttgagcattccttgctacaatgcttccgagagaagggaaaccggcaaagggggaaaagagacgaatagaagggcattggtgccctctcacacacaggccaagatcgtgatagctattgcaagatgatgcacaagtacataggatcagatgttacataacttgtgacacttccagtcataatttttgagccaatgacaatgcttcagaaaatggctgagctttgttaggtgttccattttagttatctgtctacttcctttaaactggttctggttatatgcgcgcgtatctattattatgtataagcattgttgctactggtccttatcgagaatcgcataaggagacaacttcatgggtatgttcagatagtttatcttttgttgcttattgtctgtgtaaatacacaaggcgcctttgatagcacttggtttccctgttgggatttttagcttgtcttaatatccaacttacaccaccatctgatatctgatcctgacaacaggctaggaggcttaactgacggtttcgaccttg

SEQ ID NO: 17147 - DNA, 612 bp, Zea mays
  Clone ID: LIB3279-218-Q6-K1-A4
ccctcatccgccgccgctttcctcccaggtcccaccacgcgcgcggccggcgggcggccaacggcggggagcagcaccgcgcgatcgtcaccgacgcctccacctccgtggctgtgtcagaacaaggtagcaaaatgaacagccacctaagcttcgaggagggctggaaagtcctggaacaggggattgtaaaatgctcgaagattttggagtgcaccagtacaaggcctaccgtgaacgaatacatgaactactatgattgtgcttacaggatggctgtgcagaaacaacattactgtccagaaatgtacaatggtttcaagatgatgcttgcagaatgtgtccgcacaatggttctgccccatctcatgcacaagcaaaatgacagctttttcagagagcttgtgaaaatgtggtcaaactattgcatcatgattagatgtgtaattggcttcttcagctatttggaccgctgctatgtgaagcagtacaaactaccatcgcttagcaacactgctgctacctctttctttgatccagtcttttcctacttcaatgatgaagcaagaacgactcttcttactatgatccaacaagaacgtgatgggatca

SEQ ID NO: 17148 - DNA, 637 bp, Zea mays
  unsure (1)..(637): unsure at all n locations; Clone ID: LIB3279-218-Q6-K1-A5
ccccgcgtccgctcgcacgcaccaccccggtccgccgcgatgcctcccttcccggcggcgaccaccacctcccacctcgccctcctcgtgctcttctcatcttcctcccttttcttcctctacaaatccctccgcctccgccgcaaaccgtcccccgcccgcactgccactcctacccttctcttcgcctctgtaaccggcacctccaaaaccctcgctgcgcgtctctccgcccgactgaccgccgatgccggtttccccgtccgcgccaccgacgctgccaccttcgaccccgacgaccttccttcagtccatctcctcctgctcgtaatccccacccacgacggcggtgcgacgcccccttctgcggccttcctttcgcgctggcttgaggagtccgccgctgacttccgcgcgggtgcactcctcctttccggtctccgcttcgccgtcttcggggttggttcccgggcctatggggagaccttcaacgctgccgcgaggaacttctcgcggtggttgcgcgcgctcggcgccgttgaagtggttcctctcggggagggcgacatcgatagcggngatctcgaagcggtgttcgaggagtggaataggagggtgctgagggtggtgaagggcg

SEQ ID NO: 17149 - DNA, 610 bp, Zea mays
  Clone ID: LIB3279-218-Q6-K1-A6
gtttgcgtcgttttcgggagggccaaagggtgcacatacaaggttcttcagctgatcgagagaagatgtgaagggcaactaagcatggatgagtaccagctcgtacgagattgtctatgcggacaaatgtatgattcaagccctgtggattttgtcagtgacttgggcactcgcttcctcctcgatccaagtgtcctgaagatgtctgaacctcctcgtgtcttgtcatggatgactaagggcattgcctcaggtcttgatgttcttttcataaacaaatttgaagaacaacgtaaagattattgggaaacactatactcatcggtgcattttggtccaatactaatactctgctcagaggatgatcaacttgctacatattcagttgttcaaaattttggccagcatctgctagagcttggtggtgatgtgagcctaattaaatggcatagttctccgcatgtcggccactacaagcaccatcctgaggaatacagagctgctgtgacggagctcctaaagaaagcctcgacgctctacgcgagcagacgacaactcaacggacacgccgtgggcacaagcgagcacaccgacgcgcccgcgcctgcat

SEQ ID NO: 17150 - DNA, 628 bp, Zea mays
  Clone ID: LIB3279-218-Q6-K1-B1
ctttatcccaaattacaatgtatcagtggctgaagtgcttattcctggtagcgaattgtcacagcatattagtactgctggtatggaagcaagtggaacaagcaacatgaaattctctctgaatggttgtgttatcattggcacccttgatggagctaatgttgaaataagagaggaggttggagaagataatttcttccttttcggtgccaaagccgatgaagttgctgggctgaggaaggacagagaaaatggcctgttcaaaccagacccacgttttgaagaagccaagcagtttataaggagtggcgcttttggcatctatgactatgaacctctcttggattcccttgaagggaattctggatttgggcgtggtgattatttccttgttggctatgacttcccaagctacatcgatgcacaggaccgggtggatgcagcctacaaggataagaagaagtggaccaagatgtccatcttgaacacagctgggagtggcaaattcagtagcgatcggaccatcgcccagtatgccaaggagatatgggacatcaaggctagccctgtcgtgtgaacgagggggttgcgattcaacaccaaacgtagtttcttggggtgctataat

SEQ ID NO: 17151 - DNA, 627 bp, Zea mays
  Clone ID: LIB3279-218-Q6-K1-B2
ctaacttatgaagaagcttggtgccttatacgctggatgacctgcaagttacttgaataaatttgagccatcatattatacaaagaatggaaaagatcccctagtctatccctacattctgttcttaagcatccaattactcccagcaattctttatttgtctaaagaagttggagaggatggataccatgttgatgctgtgcatatttcaattgctttagctgaccatagtgttctccctgacggtattgggtcaggccagaaaattggcgtcatggatgcctttgcagaggctgcaagcataatacgacagtatggctctatatacttgcgtaatggtaacattgatctagccttggagtattatgcacaagctgctgctgccatgggtggaggtgaggcatcgtggattggtgaagggcatgctgataagcagcgacaacgaagtttgatgttgaagcaactactgatggagatattgctaagggatggtggtattcaacttttgcttggtccaagtggaatgggagaagaaggagagctgaaaaagttatgatggattggagaagtaggcagcaattcttacttgaagctgcccatcggtgtcaagaggctgggctctatgac

SEQ ID NO: 17152 - DNA, 620 bp, Zea mays
  Clone ID: LIB3279-218-Q6-K1-B3
aatagtcgccctctcacttttgttgggtccgtctgtggattgtccccggcctccttaccgtcgcgtccaaatcatcctcacaccccgcagcatctccacgccgccacacctcgtcgcgtcgcgtcgtctccgccgagaagatggtcggaccaggcctctacaccgagatcggcaagaagaccagggatctgctgtacaaggactaccagacagaccacaagttcaccctcactacctacagctccaatggcgttgctgtcactgctactagcacaaagaaagctgacctgatcttcagtgagatccattcacagataaagaacaagaacatgaccgtagatgtgaaagcaaactcagagtcaaatatcattactacagttactgtcaatgagattgcaacaccaggactgaagactatcttaagctttgctgttcctgatcagagatctggaaaggttgagcttcagtatttgcatgattatgctggagttaatgcaagcgttagtctgacagccaatcctgtagccaacctctctgctgcctttggcactaaggctctcgcagttggtgcagaaatctcatttgattctgccactgggaacttcaccaaatacaatgct

SEQ ID NO: 17153 - DNA, 627 bp, Zea mays
  Clone ID: LIB3279-218-Q6-K1-B4
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcg

SEQ ID NO: 17154 - DNA, 284 bp, Zea mays
  unsure (1)..(284): unsure at all n locations; Clone ID: LIB3279-218-Q6-K1-B5
ggctcccaccccgtcgcggnaagtgccgtcgcgtaaggcgaagaagtagagcggtggtcttggcaggaatctagggtttcatgctccttcgattttagatgtttactcgtttttgctctagttgtgggtggtgtgcggggtgggttactaggttgtaaatttgatgccggaggctggggtacacatgggcattctgtaccagcggtggaagggcggaggcgccggcgacgatgacgaaccagtgtgtgttattattagaagacgaagttgtatttctgtagctg

SEQ ID NO: 17155 - DNA, 629 bp, Zea mays
  unsure (1)..(629): unsure at all n locations; Clone ID: LIB3279-218-Q6-K1-B6
ttgcggatgaaaacagcccttgcaagagcatttctccttgcagatgatgtccttcgtcagggtgttcaaggaatatcagacatcatcacaataccgggacttgtcaatgttgattttgctgatgtaaaagctgtcatngaaaaactctggaactgccatgctcggtgttggtgtttcttccagcaaaaatcgggcccaagaagctgctgaacaggcaacacttgctcctttgattggatcatccatcgaggcagctactggcgttgtgtataatattactggtgggaaggacatcactttgcaagaagtgaacaaggtgtcccagattgtgacaagcctagctgacccatctgcgaacataattttcggtgctgtcgttgatgaccgttacactggtgagatacatgtgacaatcattgcgacaggatttccacagtccttccagaaatcccttttggcggatccaaagggagcacgtatagtggaatccaaagagaaagcagcaaccctcgcccataaagcagcagcagctgcagttcaaccggtccctgcttctgcttggtctcgaagactcttctcctgagaagctcatttggtgaaccgtgactcgtagtgcattagatttgcat

SEQ ID NO: 17156 - DNA, 508 bp, Zea mays
  unsure (1)..(508): unsure at all n locations; Clone ID: LIB3279-218-Q6-K1-C1
gcaaacttcaacttccagcccggccctttgcattggtggtatagtgaagattgaactactggggaggatacangaaacaatttacagatgataagtattacatatgtgtctgccatgtccaagtgacggggcgctcgctctcaccagatttaatgatagacctctccgatcctgctggttactcgaacctcaagtatctgccgggtgccggtaacttgcgcccagaagacctaatcagcattgacgccaaggactcaccggactggcgctcgcttgtttccaggtacaggcagatgaggcaactggccatggtgtacatgctgcttggacccgtgcagtttatggatgaagacgaagttgacttgcagatgtaggctttgttttccctgaaccggatcttgtgtatcctaattgaacggagcttgctctgataaatatagtgagaaaagatatgtgtcgctgtttaaaaaaaaaaaaaaataaaaaagagaatatacgtttaattttt

SEQ ID NO: 17157 - DNA, 163 bp, Zea mays
  Clone ID: LIB3279-218-Q6-K1-C2
gttctctgctcattcgttcgccacctcgccccagaagtctcgctagggtttcgccacagccgccgccatgcctcgccgcaagcttaggaaggtccgcggctcacgcccggctccacatgctgctccagtgaggaacccaccacagcctgcgcgctagggctcg

SEQ ID NO: 17158 - DNA, 652 bp, Zea mays
  Clone ID: LIB3279-218-Q6-K1-C3
ggggaacagcgtccggttaaagcattcagtggccatcagagtgaagttaatgctatcaagtgggatccgactggttctcttttggcttcatgttctgatgattggacagcaaagatatggagtatgaagcaagacaaatgtgtatttgatttcaaggagcataccaaggaaatatacactattcggtggagcccaacaggcccaggaacaaacaatcctaatcagcagttgcttttggccagcgcgtcttttgattcaactatcaagctttgggaagtcgagcaaggatgccttctgtacagcttgtctggtcataggcaaccagtgtattctgttgcatttagccccgacggcgaatacttagcgagcgggtccctggatcagtgcctacacatctggtctgtgaaagaaggcaggatcctgaagacgtacagaggtactgggggcatattcgaagtgtgctggaacaaagaaggcagcaagattgctgcctgtttctccaacaacacagtctgcgtgatggatttccggatgtagtccaaccagtagggtggtgcatatcaatcctaacacaaggctagatcataaatccgtcccatgcaaatttgtgaagagcggagttgttagcaaaatgtagatcctaggtggcttc

SEQ ID NO: 17159 - DNA, 618 bp, Zea mays
  unsure (1)..(618): unsure at all n locations; Clone ID: LIB3279-218-Q6-K1-C4
attgaacgaaggnanacgggagaaaacgactcgtcactcgtcagtctctcgtcctcatgccgtcgccgctgggtggacgaatccaattcgggcctggcaaggctggcatgccgtcggcctccctagctcgccgcctcctctctactatatcatctccagcgatcccttcacgcagtaccagcaccagcgccagcaacagcaacagctgtggtttcagcgcaagaagggccaggaagaagcgcagctgcgtttcttggacggtgagcgcggctactccggcggacatggcgaccaacagcggcagtgccctggcgaagctggcgccgctggaagccatcctgttcgacatcgacggcacgctctgcgactccgaccccatccacttctgcgccttccgagagctcctgcagcaggccggcttcaacggcggtgtccccatcacggaggagttctacagcgccaacatcagcgggggccacaacgacgacctcgccaggtcgctgttcccgggcatggatcaccagaaggcgatgcggttcatggatgacaaagaagctatgttcagaaagttggcacctgngcagctgaagcccgtggatgggctgcaggagctgtgcg

SEQ ID NO: 17160 - DNA, 656 bp, Zea mays
  Clone ID: LIB3279-218-Q6-K1-C5
cgcaccggcaccaccaccaaccgagcggctccaggctcctgctcaggaaggggagaagaggcgagccttccttgggaagtcgcaggaggagagaaggggaacaaagatggggcgcggcaagatcgagatcaagcggatcgagaactccaccaaccgccaggtgaccttctccaagcgccgcaacgggatcctcaagaaggcgcgggagatcagcgtgctctgcgacgccgaggtcggcgtcgtcgtcttctccagcgccggcaagctttacgactactgctccccgaagacatcgctatcaaaaatcctggagaagtaccagaccaactctggaaagatactgtggggtgagaagcacaagagccttagtgcagagattgaccgtataaagaaagagaacgacaccatgcagatcgagctcaggcacctgaaaggtgaagatctaaactcgctgcaacccaaagacctgatcatgatcgaggaggcacttgataatggactgacgaacctgaatgagaaactgatggagcactgggaaaggcgtgtgacaaacactaagatgatggaagacgagaacaaattgctggccttcaaactccaccagcaagatatcgcgctgagcggcagcatgagagagcttgagctgggttaccata

SEQ ID NO: 17161 - DNA, 586 bp, Zea mays
  unsure (1)..(586): unsure at all n locations; Clone ID: LIB3279-218-Q6-K1-C6
cagcttcagnaccatcgaacanaagaggcccctctgctgaacaacagcacaaaacggccgcttcacttgggcttcccaaggagcgtgccgacgtcgccgagcttcagagcgaggctagacctgcgcgtcgccgctgtctacaaggtgaagctcatcggccccgaaggcaggagagcgtgctcgacgtgccagaggacagctacatcctggacgcggccgaggaggccggtctcgacctgccctactcctgccgcgccggcgcgtgctccacgtgcgccggcaagctcctggagggctccgtcgaccaggcagaccagtcgttcctcgacgaggcgcaggtcggtgccgggtacgcgctcacctgcgtcgcgtacccgacgtccgactgcgtcatccagacgcacagggaggaagacttgtactagcccgggctggtccccgtgcatggatcaaccttgcacttccattcagattcgatctttgagttattgacactgtccttggcacacgctgttgcggttgcagcttgctagaactaatcgtcgtccagataatttggcatgatgaccaagtgcaggttcttgtg

SEQ ID NO: 17162 - DNA, 605 bp, Zea mays
  unsure (1)..(605): unsure at all n locations; Clone ID: LIB3279-218-Q6-K1-D1
ccccgcgtccgttatgctgtcaacaacgttgctgctgcgtttggcattcaggactccggacatctccgcaatgcaccatgacggcacgcctgacctgagagtcgtggcggagaagctggccgacaacctcagggtcagggacacgtccttggacacgaggaagatggtggtcgagatctgcgacatcgtcacggggaggtctgcccggctggccgcggcggggatcgtcgggatcctcaggaagatcggtcgagcggcgccaggcgacgagcgccggtcggtcgtcgccatcgacggcggcctgttcgagcactacgccgagttcaggaagcgcctggaggccacgctggtggagctgctcggggaggaggcgtctaggctggtggaggtcaagctcaccaaggacgggtctggcctcggagccgccctcattgcagctgcccactcgcagtactgaacgcccaacggccgcgtgtgtcggtgtacaactcgtgctgaattcctgtacgttttcaagaacaagtttgctcggaatctgccaacaagcaagtgctctaatggaaaaaaaaaaannnnaaaaaaaaaaaannaaaaagggcggccgc

SEQ ID NO: 17163 - DNA, 344 bp, Zea mays
  unsure (1)..(344): unsure at all n locations; Clone ID: LIB3279-218-Q6-K1-D2
cgagaagaggtggccgtgttcctggncaacacgctggaggtgaagcaagccggcatggaccgggggatgccgtggtgggtgcggttccggacgttcaagggcgacagcaggaacgaggagttctaccgcctgccattcaacctcaaccgcttcttccctccggcctaaaagtcaagtcactcagccagactcagattgctgagcagaggcatagtgtagcttatttattgttccattcgttcatctctacttgttcctgttgtagattattttgatttttggagaggtccagtaagtatacttactgcccaatccactaaatgtggtcgcctaccgttttatat

SEQ ID NO: 17164 - DNA, 629 bp, Zea mays
  Clone ID: LIB3279-218-Q6-K1-D3
cggccgcgtgggcggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgatcagctgaaggcggatgcaaaggagcgcggcgaggtcatcagcaccaagaggcagccgttgggtcccaagcctggcttcatggttgaggggactaccatcgagaccgtcactcccatcccgtacgatgtggtcaatgatcttaagggcggatactaggttgtttgtttggtctttctgtgttactctagtgcgtacaattttgctcacactgagcagtagtatgaacctattgtgtgttcatgttgaaaattttcccgttctgtgcaaacctgagtttagaag

SEQ ID NO: 17165 - DNA, 508 bp, Zea mays
  Clone ID: LIB3279-218-Q6-K1-D4
cggccgcgtgggtccagactcggccgacagctacggtattgacctcaacatgaccctccctcaggctctgaagagatggcaggcttttgaagatagcagccactttgacggcgcaacctcctcatttgttgcaagtttggataacactcagacgagcatccctacaaggcctcctggattcgcggagtcgttcacctctgctgacggaagatagacggttagctgctagggcgtgccaaaccttgtgtgcttccgttgaaatagaaggctcacgcgatccttgtgttcattcttttagtctcttcgctcctaatctttcatgtctccttattcggctctgtactgccgtgtagctgctctttgatcctgtcccaaaaattgcctggaagttggaaaaaatttgctaaccggttatgtcatttgctaagattaaagtagaagtatgctagggttgttgggttgtatcggatgctgacaatttccaaatgaaggtgatcctgtattcgtc

SEQ ID NO: 17166 - DNA, 205 bp, Zea mays
  unsure (1)..(205): unsure at all n locations; Clone ID: LIB3279-218-Q6-K1-D5
tgcatgcgttgctccatcttcttttcatgccaagtttgctgtcatacttgctagtgggngaaaacaacaatgacaacagtggtgagaacagcaaccacaaaaaaagagaggatggaaattattgaagttcctaggatcgtattgtaactgtacttgtgcgagtaacattattggttctctttgtatatccatctctgagacatgc

SEQ ID NO: 17167 - DNA, 634 bp, Zea mays
  unsure (1)..(634): unsure at all n locations; Clone ID: LIB3279-218-Q6-K1-D6
cttccccatccagnaattcatgcaggcgcagnacatcatggcccccagtgcgtacatctccgccgccacgctggccgtgcacctcgccctcagctacctcgtcgtgtaccagttcgggctgggcctcctcggcgcgtcgctcatgctcagcgtcagctggtgggtcatcgtcgccgcgcagttcgcctacatcgccaccagccagcggtgccgcctcacctggacgggcttctcgtgggaggccttctcggggctccccggcttcctcaagctgtccctcgcctccgccgtcatgctctgcctcgagacctggtacttccagatactcgtgctcatcgcgggactcctcaaggaccccgagcttgccttggcctcactctctgtctgcatgtcaattacagggtgggtgttcatgatatcagttgggttcaatgcagcagccagcgtaagagtgagcaacgagcttggcgccggcaacccaaagtccgcggcgttctctgtggtggtagtgacgctgctctccttcgtcctgtcggtcataatctccgtcgtcatcctgctgtgccgggactacatcagctacatcttcaccgagggcgacgacgtgtcgcgggcggtcgcccagctcagcccg

SEQ ID NO: 17168 - DNA, 574 bp, Zea mays
  unsure (1)..(574): unsure at all n locations; Clone ID: LIB3279-218-Q6-K1-E1
cggncgcgtggggcgtcaattggtgctaaacatgggtggtcagtgngaactccacagacaaagaagctgcaagatctgcttccgtcgattatcaaccagcttggtcctgacaacctggacaatctgcggaggctcgcagagcaattccagaagcaggcctctggtgcttctggtgcagaggctggtgccagcgctggggctgttcaggacgatgatgatgacgttcctgagcttgtccctggagagacatttgaggaggccgcggaagagaaaaaggagtcctcatgattttgctacatgcctgctgttgttaaaccatgccattagaagggacctgttgagaactctgacctaccttatttgtgcctgtgggactggttatgtcatgatcgagaatttggtagggcgtgctggtgggattttacatgaagtatgcctctttttttttcatccatatctcccttgcttttgtgtggtaaaagtcttgttaatggtaaaggccacactttagaccaaatcaaggtaccgtgatgcatgaagatgaataccacatatcanaaaaaaaaaaataaaa

SEQ ID NO: 17169 - DNA, 662 bp, Zea mays
  unsure (1)..(662): unsure at all n locations; Clone ID: LIB3279-218-Q6-K1-E3
cacgtgcaagcctgtcaaatatcctcaaaggcatgaagatctgaaagagcgcctttcacgggattctgataagctcatttttgagcgcctacagaaagaatttgaggctgcacgggctgctcaaaccgaagagatatcaataaatgatgatgagtggaatgatggtttactggcaaccatccgtgagaagaccaggttcatatggaggctgataggaaggccatgtccaaccaagtaaatgttccagcagatctttcatttcaatcgaggactacatataggattagaaataaggttatctattgcttggatggagctaggattggcatacagtatgagacattctttgctggagagccttgtgaaatttttcattgtgttttggaaagcaagtcattcctggaaaagatgattatgattgaacacaccttacctttctttctgcctgtacgtgaattagaaagtgatctgttgtcatctaattcaattaaattcattgatcatcttgattaaattttacaggcttatattgacaggagagagcaggttcgtcttatcaaggagctctacgggaaccaaattggcgagctgttccatagtcttccttataatatgatagagtttgtattggaggattntgagtgcaaggttacaatcagtat

SEQ ID NO: 17170 - DNA, 525 bp, Zea mays
  unsure (1)..(525): unsure at all n locations; Clone ID: LIB3279-218-Q6-K1-E4
cggccgcgtggggtcgcngaggcaggccatcgtccgccatgacgctctccctctccacctctttcctccccatccccgccgccgcgaggaccaccgcccgcaccctacgctccgtcgtcccctcccagggatgcgctgctcgatgcgcaagaaggggttgcacccggagatctacgaggacgcgaaggtgtactgcaacggcgagctggtgctggtgacggggggcaccaagccggagtacacggtggacgtgtggtccggaaaccacccctactatgtcggcgacacctcggcgctcgtggtcatggacagccagatcgagaagttccgcaagaagtggggccacatcaaggagtactggcccgaggaccagtggagggagatgcacccagacggcgacccggagttcgagcccgagggggacaactgattgatggctccccgtcttcctcacccggtgcgtggtcaccggtccagtttacatttgccctcttgaatggaatcgagactctgtctgttcgcatt

SEQ ID NO: 17171 - DNA, 635 bp, Zea mays
  unsure (1)..(635): unsure at all n locations; Clone ID: LIB3279-218-Q6-K1-E5
ctgttgttgagccatacaatgcaacactgtcagtccatcagttggttgagaatgctgatgaatgcatggttcttgacaatgaggcactttacgacatttgcttccgaactctgaagcttacgacgcctagctttggagacctgaaccacttgatcagtgcaacaatgagtggagtgacttgctgcctccgcttccctggacagctgaactcggacctgcgcaagctcgcagtcaacctgattccgttccctcgcctgcacttctttatggtcggctttgcgccactcacctcgcgtggctcgcagcagtaccgtgctctcactgtccctgagctaacccagcagatgtgggatgccaagaacatgatgtgtgctgctgacccgcgtcatggccgctatctcacagcatctgccatgttccgtggaaagatgagcaccaaggaggtggacgagcaaatgatcaatgtccagaacaagaactcgtcctacttcgtggagtggatccccaacaatgtgaagtccagtgtttgtgatatcccgccacgcggcctctccatggcctccaccttcattggcaattccacctccatccaggagatgttccgncgtgtgagcgagcagttcactgctatgttc

SEQ ID NO: 17172 - DNA, 659 bp, Zea mays
  unsure (1)..(659): unsure at all n locations; Clone ID: LIB3279-218-Q6-K1-E6
cccagcgtccggcatcaccccaccgctccctgcaactgcaactctgtttcacatcgtccgctcgtcatacccccgaggccccgatccccctttcatttcaactcgcatctcccgcgccgcgccgccccagcccggcagcccccatggacctgccagtggtagatctcacgccgtatctcggggccgcagccggcggcccggccgcgtcgggcgtggaggagctgcgcgcgctgtgcgccacagtgagcgctagtctgcgggacacgggggcgctgctggtgatggacccgcgctgctccgccgcggacaacgaccgcttcctcgacgtcgtcgagcgctacttcgcccgatccgccgacgcaaagcgcctccaggaacggccccacctccactaccaggttggtgtcacacccgaaggggtggaggtgcctcgcagtttggtcgacaagaacatgcaggagaagatcaggagcatgcctaaggactttaggccagccactcctaaagggccggacccgaaatggcggtacatgtggagagtgggtcctcgccctacaaacacccgttntaaggagctaaactcagaacctgttattcctgagggattacctgagtgggaagaagatgatggattcctgggttctaaaatgatttctgca

SEQ ID NO: 17173 - DNA, 602 bp, Zea mays
  unsure (1)..(602): unsure at all n locations; Clone ID: LIB3279-218-Q6-K1-F1
cggccgcgtgggcggncgcgtgggcgcggagagcgagagcccgggagaacagcggccggcggcaaaaggtgcagcggctcacctaccggaagcgccacagctacgccacaaaatccaatcagacccgcgtggtcaagacccctggtgggaggcttgtgtaccagtacaccaagaagcgcgcgagcggaccgaaatgcccggtcaccgggaagaagatccaaggaattccacacctgagacctgctgagtacaagaggtccaggttggcaaggaaccgcaggactgtgaaccgtccatatggtggtgttctgtctggtaccgcagtgagagagaggatcatccgtgcctttttggtcgaggagcagaagatcgtgaagaaggttttgaagatccaaaaaaccaaggataaggcctccaagaactaggcgatataggcatcttccacaatgtttaagtcccttagaatttgtttcagcaagaaattttctcgtgggtttggggaatcctgatacttacacaagatatgcgagatgatatggtttaaattttgaacggaagttgcggatccttttattttttaaaatctcggtgcaatgtttatc

SEQ ID NO: 17174 - DNA, 408 bp, Zea mays
  Clone ID: LIB3279-218-Q6-K1-F2
ctctgtggttgacggtgacgacgcccattccacgggtgatcttggggatgctcacattcctgccctccgctcgtccacgcgctgggtccccaactgcactggcaggtcagtgccatagcttcgcgtgaccggaaagagagaggaaggggcgtcgaactatgaacgcagcggcggggtcgacgctgctgaacccaaagcaccgatcttcataccgaaggacctactacaggtggaggactattcggcgaagagaacggacctcaattaccaccactgtctgggtactgaaccactgatggccgcgagcgccctcacaagggaaagagggtctagcacacatatcggacggactcctcccattcgacaaggacctcttctaaacgaccatctcgagcagggaacccctcg

SEQ ID NO: 17175 - DNA, 656 bp, Zea mays
  unsure (1)..(656): unsure at all n locations; Clone ID: LIB3279-218-Q6-K1-F3
cccgtttcctccagtttcctaccttcctctcgtcccagcagccgcaagccaaaaccctagcaagcaaaccaccggagcagcggcgctcgcgcgggcggagccatggcggacgacgattacaacngaaatcgacatgggctatgaggatgagcctccagaacctgagattgaggaaggggccgaagaagagcttgagaacaacgaagatgcccctgatgatgtcataggtggagagggtgaagataaggaacaggaaaagaccaagcgtgagcgcaaaacaacaaaatatatgacgaagtatgaacgtgcgcgcattcttggtacacgagccttgcagataagcatgaatgctccagtcatggttgagcttgagggagaaactgaccctcttgagattgcgatgaaggagcttagagcgcgcaagatacccttcacgatcagacggtacctacctgatggaagttatgaagactggggagtagacgagctcattgtggaggactcctggaaacgccaggttggtggagactgaagatgctgatctacttggcatggaaaggatgtgtagttacaggtcttcgttgcctctgagtggatgctgaacagtgaatgaaccaagacgaaacgatgctatgctagatgttaccttgacgtct

SEQ ID NO: 17176 - DNA, 630 bp, Zea mays
  unsure (1)..(630): unsure at all n locations; Clone ID: LIB3279-218-Q6-K1-F4
aatccgcgnatcacagacgcgtctatctcagcttgctgcgctgcactaccctgccctgccatcatatcgtacgtgagcccggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccgccgcaccatctgcggctgcctcaagaacgtcgccaacggcgccaacgggagcggcacctacatcagccgcgccgccgcgctgcccagcaagtgcggcgtcgccctgccgtacaagatcagcaccaacgttaactgcaacacgattaattaaatgaggcgtcctgtgcgcgtccgggcgaggaatgcatgcatggcggagagtaataaagtaatgctactggtattttaagctagatcgaggtgtgcctgtctctagtcatttatggtgtttagcaatcgtctacacagttcgtaaacggtgtat

SEQ ID NO: 17177 - DNA, 633 bp, Zea mays
  unsure (1)..(633): unsure at all n locations; Clone ID: LIB3279-218-Q6-K1-F5
ccacgccgtcacagcctcggntggcactaccaagaacttctcaagttggaggataaccggttgatcgagacagtggggattcctgtcgatgatgacaacaaaggctcttctaggctcactgcctgtgtttcatcacaggtcggctgcccccttcgttgctcattttgtgccacggggaagggagggtttgcaaggaaccttcaaccacatgagattgttgaacaggtgttggccatcgaggagacgttcaaacacagggtgacaaatgttgtgttcatggggatgggtgagcccatgatgaacctcaagtcagttctagaagcacaccaatgcttcaataaggaactaaaaattgggcaaaggatgatgacaatatctacagttggtgttccaaatacaataaaaatgctagcatctcacaagcttcagtcaacgctggcagtcagtctgcatgccccaaatcagaagctgcgggagacgattgttcctagcgccaagtcttaccccttgggagcactaatggatgactgcaagagttacttccttgaaactgggcgcagggtatccttcgagtacactctgctagctgggattaacgatgaaaaggagcatgccgaagagctagcagaacta

SEQ ID NO: 17178 - DNA, 609 bp, Zea mays
  unsure (1)..(609): unsure at all n locations; Clone ID: LIB3279-218-Q6-K1-F6
gttccaaactgaanagttcttagccagtacgctgagaagcgtcctgagaattctaaagggctcctccttgcacttgcccagattgctgctaatgccaaccattttcagcttgctgctgactcactatccagaatacctgacattcagcacatgcctgcaacagttgctacattagtggcccttaaagagcgcctaggtgactccaatgctgcagcttctgtacttgattctgctatcaactggtggaagaattccatgaccgaggataacaaattagatatattaacacgggaggctgctgcatttaagctcagccatggacgtgatgaagaggcttgtttgttgtatgaggaacttgtgaagagccatggaagcatagaagctttggctgggctagtaatgacttcagcgcgcactaacttggagaaggcagaacaatacgagaagaaactgaagccattgccaggcctcaaaggagttaatgttgagagcttggagaagacatctggtgcaaggcatgtggaagggccccaagacatgaaggtagatgttcccgaggaagtgaagaagcaaaaggcaaagaagaggaagcggaagcctagatacccg

SEQ ID NO: 17179 - DNA, 641 bp, Zea mays
  Clone ID: LIB3279-218-Q6-K1-G1
ctctaaagcatagaatcctatcaacccatatggcaaggcaaagaaaatgacagtggacatcattctagattttacaaaatcaaaggagcaaccagacatggctgtcatgatctaagatacttcaacgtgattggatcgaacccaaacatatgactaggagaagctccaaggccactttgtcaagggtctctgcaatgcacctactggtgcatgatttactggaggttgtgcgcatgaatgtgccacacattggtatgggggttggagttgaagcaggagacatgattgttattcctatcatgtgcacactgcctcctcgctgtcatttgtcgtcactctcgtagtcctgataccggagcatggttgccaggggagagcagtccaaggcaaatttgccatgttggagcagtcacaggagccaaggggctgcagtcacaggtcctgctagccaggatggagcaatcataggacctcctagcagtccaaggaaaatttgcgaggtggagtagttgcaacttttgaaacccacgtgataacatgctcaagcgttcgtatgataaaaaagaggcacataatcaaaagaagatctcatgttctgcgtttgtgaacctgtttgtattttttgaacttgttttgtgaac

SEQ ID NO: 17180 - DNA, 631 bp, Zea mays
  Clone ID: LIB3279-218-Q6-K1-G4
ggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaactccgacgggaactggaggaactgagcggtggggcccgcgcggccaagttatcctgttcgctaccgtgttgtttaccctagtccagagtgtttatcttcgttcg

SEQ ID NO: 17181 - DNA, 645 bp, Zea mays
  Clone ID: LIB3279-218-Q6-K1-G5
cgttattcccgacttgagaagtttgatcggttggatatttttcaagagtacattcgacacctagagaaagaagaggaagagcagaagcgggtacaaaaggatcaagtgagaagacaagagaggaaaaaccgtgatgggtttcgtaaaatgctggaagaacatgttgctgatggcacacttaatgcaagaactcggtggcgtgattactgtgcacagataaaagattcacagtcctacttggctgtagcgtcgaacacatctggctctacaccgaaagagttatttgatgacgtgatcgaggaacttgacaaacagtatcaagaagacaagacccaaattaaagaagtggtgaaatctggaaagattcctatgacaacatcatggacattagaggaattccaaactgctattctggaggatgatgctcttaaaggaatatcaatcatcaacatcaagcttatctatgatgatcagcttgaaaggctcaaggaaaaagagcaaaaggaggctaagaagcgccagcgtttgggtgaaaatttttcagatcttttgtattccatcaaggaaatatcagcttcttcaacatgggatgattctaaacagcttttcgaggatagccaagagttcagggccttggacagtgag

SEQ ID NO: 17182 - DNA, 498 bp, Zea mays
  Clone ID: LIB3279-218-Q6-K1-G6
ttccctccaacgccgctgccacgtcgtcgccccgcgccttccgccccaccaactcaccggcgaggtttaggacacagcgcatctcgccgcagcggatgccgtatatatccgcgcgccgagcttgagggacgccacaccccaccctcccctcccatcgcgattcgcgaatcaccaaactgtgaaaggaaggagacgaacgaggcagcggaaaggggagaggattttttcagattttccggcagcgacctacccagcccagcgagagagaccgagcgacagcagctaccttctcccgacatgacgccgcatctgcccgctgtctcctcctcctccacgacgaccacatcccgcgccgccgccgccgccgccgcgcctccgtcctcgccgcatcagtaccggaggcggaggcggcgccgggtgccgggctgcctccgccctcgcgccgcgtccgtccgctgctgcgccgcggcggcgcccgcgccgcaggcagcggtgccc

SEQ ID NO: 17183 - DNA, 628 bp, Zea mays
  unsure (1)..(628): unsure at all n locations; Clone ID: LIB3279-218-Q6-K1-H1
cgcgnactcgccgtcgccgcagccttggccatgtcgatcttcgagtataatgggtccgccgtggtggcgatggtggggaagaactgtttcgcgatcgccagcgaccggcggctgggcgtgcagcttcagaccatcgcgacggacttccagcgggtgttcaaggtccacgacaagctttacatcggcctctctgggctcgccactgacgcccagacgctgtaccagcggttggtgttcaggcacaagctgtatcagctgcgggaggagagggacatgaagcccgagacctttgccagccttgtctctgcgctcctctacgagaagagattcgggccatatttttgccagccagtcattgctggacttggagatgacaacgtaccatttatttgtactatggactgcttaggtgcaaaggagctggccaaggattttgttgtatctgggacagcatcagaatctttgtatggtgcttgtgagtccatgtacaagccgaacatggaacctgatgaactcttcgaaactgtatcccaagctctgaattcatcaatagaccgtgactgccttagtgggtggggtggctatgttctgattgtgacaccgactgaagtgagggagcatgtgatta

SEQ ID NO: 17184 - DNA, 642 bp, Zea mays
  Clone ID: LIB3279-218-Q6-K1-H2
cttttccttatccaagccagccaacaccggtggctgaaactagtgcaacagtgtcacagaacataacttcatttagtagcaacaaggctactgctcttccaggctcaacactgtcataccaaactgcatctcagtctgtttcttcgactattgccccatctagctcagcacaagtggagatggctgtgcctttgttggcatcatcaggtcaactattgcagaacacatcatccatgctttcatcatcacactccatgcaggcaccattacaggtggctagcaaagaagtcaagccggttgagccaaaggctaaggttgcagaaccattactgcctgatcctttgctaccagacccaccatcacagtctctgcctgaaaataaggagcctatattgccattgcccaaacatacacctcagaagttttcacagtcagtaacaacattcactgaagaatttgatttcacggccatgaatgagaagtttaacaaagatgaagtctggggtcatcttggaaagaaatcgcagtcaagggacaaggatggtgaggtgggagatgatgtgtttgatgaagacctggaggttgaggaaactgataacccagagctatctgttaagcctgtttatgtcaaggatgattttt

SEQ ID NO: 17185 - DNA, 651 bp, Zea mays
  unsure (1)..(651): unsure at all n locations; Clone ID: LIB3279-218-Q6-K1-H3
gcgttcgcatatnaccccaaacctaggttctagtcgcttctcgtcgtttcgttcgtagatcacagagacaatggtgaaggcagttgctgtcctcgccggcactgatgtcaagggcaccatcttcttttcacaggaaggggatggtccgaccaccgtgactggaagtatctctggcctcaagccaggcctccatgggttccatgtgcacgcgcttggcgacaccaccaacggctgcatgtcgactgggccacacttcaatcctgttggcaaggagcatggtgcaccggaagatgaggaccgccatgccggtgatctggggaatgtgacagcgggagaagatggtgttgttaatgtcaatattactgacagccagatacctcttgctggaccccactcgatcattggccgagctgttgttgtccatgctgatccggatgaccttggcaaaggtggacatgagcttagcaagagcaccggaaatgctggcggacgtgttgcctgtggtatcattgggctccaaggctaaagcggttaacctccgaggcaaacaccatagaagatcgaagcgagcacctcaggatgttgctgttccatttcccctgtattggcaacacaatttgagtacaccaaataagcgcctgatccatgatc

SEQ ID NO: 17186 - DNA, 631 bp, Zea mays
  Clone ID: LIB3279-218-Q6-K1-H4
cttacttccttctgcccacagctcttcggccgtcagggatcaccgacgcctggccgacggcgcccggcttctcttttcttgtttgtttttctggctcggccaaactgctttctactgccttgttgcctcggccaacggctgaaaaaaaaatcagtcgtctcccagcctcaccaccgagcacgatttcttctctctgatttttttttctttgttctagcatctggccgctagttccctggagacaccactggtcgtatggccacatgaaggctatatgcttcacggtgtcactttctgttgtgtgtgtttttttttttttgcttcttctttgcatcacttgtactcagccgaaaaaaaaaccttggtgctcatggccacttctggttacacttatactcagatccaaactcatgtattcggtccctctcttcttatgaatgtatgtatgagatgtgtcttgttgtaatttatgggatcgagtacggaggtctaaaacgtgggtctggttccttttgcgtttttgtctgtgatttacgcgtggatctagtcactggattaaacgaacagtgctctgtgcactttgactgatccggattttagggttaatttagttagggttgagccctaactg

SEQ ID NO: 17187 - DNA, 510 bp, Zea mays
  unsure (1)..(510): unsure at all n locations; Clone ID: LIB3279-218-Q6-K1-H5
caggnagcgcctcttccagcggcggatcagcagcttgctgaggcggggcccgtccctgttatcagcatccgcctcgacgagctggagcgcctcttccgcccctgcccgccgccgaccaccaccaccaccgacaagcggcgccgctccggctccggccccagccccagatccgccacgaaacatggtgctcagctgcagctgcgcagcatgaattgaattgggttagcgtaacgtagcttgcacgcaccaaccaaccactccctttttagtttttgctgctgcatctgtctgcttcttgttgctgcaacaagcaaagcgcaagcggtggcgcttctttttatttatttatttattacggagtacttgcttccgttctcaaatatttgtcatttgatagttcatttcaaaaatgtgacaaataaaaaaagaacgacgaagcaagcagtacccacctgtgtaaatcaaatcaaatatgcaaagttaccgccatagcaataaaatcacccgtgt

SEQ ID NO: 17188 - DNA, 650 bp, Zea mays
  unsure (1)..(650): unsure at all n locations; Clone ID: LIB3279-218-Q6-K1-H6
cccagcgtccggcttccaggcagtgggcacctgtttacagtgatctcgctctgggtcctcagnaggaaaagacaaggcagtacatcgttgccagtaaatttaatcggtccaaagctttatgtttgcactaacatggttgatgtgggtaaaagaccagttacaggactccggttgttccttgaaggaaggaagagcaacaaattagctgtacatcttcaacatctctgctctcttcctcagattattcagcttgaagacgacccttacaatcaccaaaccccggaatatgaccgcaaatactacgaaccaattggaccgtggaaacatttctctcatgtttgcacagcaccagtcgagtcagatgacctgtgcatcgtcacaggggcacaattagacgtggtccaccaaggcctcaagaaaattttgttccttcgcctacatttctccaaagcctgcaatgccgttgtgaggaactcggaatgggagaattctcccaacatagctcagaaatcaggccttatctcaacactcattagcacacatttctcctcggtagctcagacgcctccgccgcggccagccgatgtgaacataaactcggcggtgtaccctgggggaccacctgttccagtgcagaccccaaactgctg

SEQ ID NO: 17189 - DNA, 417 bp, Zea mays
  Clone ID: LIB3279-057-D4-F2B
catcagggggaaaacatacttgaacagaaggtttcgacatgagcaggccggagcagttagctaatagagggagatgagggggtaagtgttctttgacggacgttctggcgcatgtgcctttgacggacgggggacaggtttgtaaaacacgacgcgacactaatgacccttatcatgttgattggcttgggcttggcttgcatctccagttctccgcaccacaaatctaaaattattctttgcactgttggctagcctgacctgacctgacctgacagttactgggcagtcatgtttttgttgttggagcggtaatttctgccgggcaatcctatgtacagttccgtttccacgtccatcccgacatccttgggccccgtgtgatcaatggctgccggccctggaggcggtggagga

SEQ ID NO: 17190 - DNA, 661 bp, Zea mays
  Clone ID: LIB3279-060-A7-R3A
gtaccagagggagttttgccgctgtcacttgcatcagcttcattttctaactgttctgtaggtgctgccgttgcgatgactgttgtactaccgcctccagtggtagccggcatggttacatcgacaggcgtagagtctatggatggatagtgaacaggaccgttgtagaaggtttcttcagcaaacggtggcgcggttggggttgggagagcctgaagtgcttcctgtggaatcaagactggaggagggttggtttgggtttggtggggtttcgatgaactttgactagagcttgttccgggcacatcccatccattgtaagtgctgctgcttggggcgtctacccggacctgggactgaccgctcgtctttgatggtgcaggagtggctggtggtccccatccgttgtgagaattacttggaggggcagcccagccattgttgttgggggtggatgcatttggttgaacattgggcactgatactccctctgcaatagctgattgaatggaggcattgatagccattgctaattcaacatcctccttgctgggtgcagattgttctgaaggcgccacagatgaaattgccggtgctggatttggcatagggagatttgctggtgctactggagccgtgttcaaaacctgtgccatgccac

SEQ ID NO: 17191 - DNA, 615 bp, Zea mays
  unsure (1)..(615): unsure at all n locations; Clone ID: LIB3279-215-Q6-K1-A10
ngagtgatgcaatttctggtgagtttggtgtcaaacttcgccttgatggtgttcaaaagaaatggggaaggccaacatattcttcttctcaccctcaactcgatcttatcaccaacacccatggggcctctcattctgatgggggagggtcaagttcgcaaccacgggagtcatcatacggttctaagagacagcagggcacggaagtttcagcagaaaagcaacggctggctgcttcactttttggttcagcagcagctaaagctgataggaaagcacaagcttctcgaaagacagcaaaggacagtccctcaactgagaaagtggctaccactaatgtgactgcccagcctgttaaggagcaagtaatccctgctgcaccaccgcctgatctgctggatctgggtgatgagcctgtttcatcgagtccaccgtcggctgaccctttctcacagctagaggggctccttggaccagcatcggctgccccggtgctttctggaactccggctaccagcacttccaaagcaccaggccttctgtcaatcttctcagatgatgtaccaaccggagtgactagtgtgtccaccgatcccactctaggtgatgttaatt

SEQ ID NO: 17192 - DNA, 624 bp, Zea mays
  Clone ID: LIB3279-215-Q6-K1-A11
caaattctccaatcaaactcactccaagagtttctctaagagttcagacactaaaatcaactcaagctatgggtgatgccatgaagggtgtcacaaaggcaatgtcccaaatgaacaggcagctaaatctaccaggattgcagaggataatgcaagagtttgagcgacagaacgagaggatggagatggtgagtgaagtgatgggagatgccatagatgatgctttggaaggagatgaggaagaagaagaaactgaggagcttgtgaatcaagtacttgatgaaattggcattgatatcaaccaagagcttgttggagctccgtcggccactgttgctcaacctgcttctgtgggaagggtcgcccaggctgaaagtgctgggaatgctgacagtggtatcgacgctgatttgcaggcaaggctagacaatctgaggagaatgtaggtgctacactagcaaaaagagtagtgccttcaagcactgttcctgcgaatgtgaatgaatacctgatcgatcaaagcggttacaagccaatgtgtatgttgaaatgaatgaagtgttcaatatgccggtagtaataacaaatgatgattatatatttattacatgtattgtcatatgc

SEQ ID NO: 17193 - DNA, 312 bp, Zea mays
  unsure (1)..(312): unsure at all n locations; Clone ID: LIB3279-215-Q6-K1-A8
ttcagcctctgnanaagatcgggattctgattcagatggtgatgttagngaaaagagtttcaaacgctggaagagaagagtctgatcagaagaaactagaaattgaactccgtgagaaggcccttgaatctcttagagcaaagaaagccatcaacaactagactgagaaattttttgtgacacatttgagtttctattttcaagtggaagtgtccttatatgatactatntaatgttctgtgtgtttatgtggcagttgatctgatgattcctgagctgtttacttgatgcagctgaattcaggcttagcag

SEQ ID NO: 17194 - DNA, 653 bp, Zea mays
  Clone ID: LIB3279-215-Q6-K1-A9
ccccgcgtccgcttttcctttcataaaccccaagccgcgccgcaatagctcgccccctcgttcgccgcctctcctgctcctaccgcagctctccctcaggtttagtgttcgcaatggcggccttcaacaagcttggtggccttctaaggcacagtgctctggtgagcggtatcactggtggctcttctcctgcagtgttcaatgctgcacggctcatgtctaccaagctatttattggtggtcttgactggggtgttgatgacgtgaaactaagagaagcatttagcagctttggagaggttactgaagcgagggtgatcacagacagggagactgggaggtcaagaggctttggctttgtgaactactccgacagtgatgctgccaaggaagctatttctgcaatggatggcaaggaaattgatgggcggcaggtacgtgtcaacatggctaatgagagacctgctgggaaccgtggtggtggtggctatggcggcggcggctatggaggtggtggctacggaggtggcggcggctacggaggtggtggctatggtggtggcagccaaagctatgatgcttgaggggggcaggatcctattaggtgcattatcaaccaagatatttgaaataatgaactttaggacttggta

SEQ ID NO: 17195 - DNA, 297 bp, Zea mays
  unsure (1)..(297): unsure at all n locations; Clone ID: LIB3279-215-Q6-K1-B10
cggncgcgtggngccgagaaataccaggctcacttcagcgagtacatcaagaagggattgaggccgatgacatggaagctctgtacaagaaggtccatgctgccatccgtgctgatcctagcatggccaagtcaacaaaggcgcaaccaaaggagcacaagaggcacaaccccaagaagttgacctatgagcagaggaaggccagactcgtggaaaggctcaatgccctcaattcctcgggtggtgtcgatgatgatgaggatgacgaatgaagtgctagtcgcggcacagtagtgc

SEQ ID NO: 17196 - DNA, 634 bp, Zea mays
  Clone ID: LIB3279-215-Q6-K1-B11
accccgcgtccgccctgttaccgtttattctctaattagaggatcttttagaagggtttttctatctggatttgtgacttcactgtgctttcttgttctttcgtttgttgctgattattactgctatggtcgattgacattctcggtgttcaatcttctgaaatataacgttattggtggcggcgaaagtcacttgtatggaaccgaggggttttcattttacttcaggaatggattcaataatttcaattttgccttcatcctggctcttcttttcttgggggttgtaccatttgcaagaaagaaatatgctcctgatctcctgatagttgtctctcctgtctatatctggttggctttcatgtctttgcaggcacacaaagaagaaaggtttctctatccaatttattcattgatatgtgttgcagctgcagctgttattgacagtttacctgattttttccatgacaaatattcatctgatcagtctatttttgaaaagatagcgaagggtctgcgtcctttgatacttggttttattctgtgtgcttcccacagccgaacattttccatgttaaatggatatggtgctcccctgcagatctatcagcatctagaacatcatgatgacact

SEQ ID NO: 17197 - DNA, 253 bp, Zea mays
  unsure (1)..(253): unsure at all n locations; Clone ID: LIB3279-215-Q6-K1-B7
gtccccctcttggcctcttctttccggcgatgggcgccggcgtcctcctcggcgacgccgccggcctgggggcccacctcgccgtacgccgccggnagacgcgcctctaccttcgcaactgggcctccaagcccctgcgcccctcggtctggctcggcgtggccgcctgtgtttcacagaatcgcgaccgccgtggccacgtgaccaggttctccgcctccgcctcgagcggcagtgacgagccccgggagct

SEQ ID NO: 17198 - DNA, 605 bp, Zea mays
  Clone ID: LIB3279-215-Q6-K1-B8
cacttcgcaaaccacctgaaaagaacccaaacaatcaatgacttttgtggttaataattatggttaccttgcgtatttgcctggttatggctttgcatatgacttctgatcacctaacattggactggtcttaattgaccaggggttgcttcttggacaagatagcttggtcggcgtagcgtctttcttattgatgcctgtcttccacctcatagaattgatctagactgtgcttactgtctcgggccagacattatttgattgacgtttgtgttcccctacagcaactaagtgaagaaaggtacatatgaggttgtgaccttacgcagaacatcaaggcggttcatgaaacagttagctggctttataccagatccaccaggcataggatcatagacacgcaccctatccctattatgccacgacgtgctacttctgcatatctttaatcttaagaactactgctataatgaaacactctaattggtgctacatctatcaagcgccactagcaacggtagtggttcgtgtatgggaacagtcatatggcctaaactttcatcgtttgatgtagcttatcataggggcttcttgttcagatttgc

SEQ ID NO: 17199 - DNA, 556 bp, Zea mays
  Clone ID: LIB3279-215-Q6-K1-B9
aaaagcgcaccatgaagatactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgc

SEQ ID NO: 17200 - DNA, 624 bp, Zea mays
  unsure (1)..(624): unsure at all n locations; Clone ID: LIB3279-215-Q6-K1-C10
gtgatatcttagnagaactacctggcttagtagacttcagtgtgtttttgaagctcacacccaagcagaaagacattatttataagttggaagcacatgatcggttcaaaagaaatgcagtagggagtgcactgtacattcatccatgtctttcagaactttcagaggttaatgctgagcatagggctaacacctttagagatgatttagttgatagtctggtagattctatcactgtgagagatggcgtgaaggccaattttttcatgaatatcctgtcacttgctaattctgcaggagagaaagtgctagctttcagtcaatatatatctcccatgattttctttgaaaggctgctggtgaagaagaaaggctggcatgtggggaaagagatctttatgatctctggtgatactagccaagaagacagagaattggcaacggaccattttaacaactctgctgacgcaaaagttatgtttggttctatcaaggcatgtggggagggtatctccctcgttggtgcgtcgagagttgtcattctggacgtacacctgaacccatctgtcacccgtcaagcgattgggcgtgcattcaggcccggacagcagaagaggtgtttgt

SEQ ID NO: 17201 - DNA, 524 bp, Zea mays
  unsure (1)..(524): unsure at all n locations; Clone ID: LIB3279-215-Q6-K1-C11
aagagcccctgntgacgtcataggtggtggaggggtgaagataaggggaacaggaaaanaccaagcgtgaacgcaaaacacaaatacatgacgaagtacgaacgtgcgcgcatcctgggtacacgagccttgcagataagcatgaatgctccagtcatggttgagcttgagggtgaaactgaccctcttgagattgcaatgaaggagctgagagcgcgcaagatacccttcacgatcagacggtacttacctgatggaagctatgaagactggggagtagacgagctcattgtggaggactcctggaaacgccaggttggtggagactgaagacgcggatctacttggcatggaaagggtatgtggtgcagtgggtctttcctgtagttacaagtcttcgttgccactatgagtggatactgtagcgaatgaaccaagacgaaatgatgctatgttaacttaacgtctgtggttgccttgaactctggaaccgtaatgctagcatggttgttggttgcgctttt

SEQ ID NO: 17202 - DNA, 261 bp, Zea mays
  unsure (1)..(261): unsure at all n locations; Clone ID: LIB3279-215-Q6-K1-C7
ccccgcgtccgcngagacaaaagacagagtcctggggagggaagcatcgatatccttcagaagtatcctgtcccagaatgtgacatttggtttatcaaattttcatgtgattttcacttcaatcagttggcgataggcaaccgtgaaggcaaaatctacgtgtgggaagtacagtccagccctcctgtcctcattgctcggctgtataatcanngcagtgtnnaaatcgccgataagaaccaaaccctgcagtgtcctttc

SEQ ID NO: 17203 - DNA, 624 bp, Zea mays
  unsure (1)..(624): unsure at all n locations; Clone ID: LIB3279-215-Q6-K1-C8
cgcacctaccattctggnaaggagaggaacagagccaagaaacagcccggaagatggcaggcggcggagtggtgaagcacatcctgctggcaagcttcaaggaggaggtgacgcaggagcgcctggacgagctcatccgaggatacgccgcgctcgtcggcgtggtcccctccatgaaggcgttccactggggaactgatgtgagcatagaaaacatgcatcaagggttcacgcacgtcttcgagtccacgtttgaaagcacggaaggaatcaaggagtacattgagcaccctgcacacgtcgaattcgcaagtgtgttcttgcctgtgctggagaaggtcctcataatcgactacaaaccgacgtcggccaattagcggtagaacatgctctgtactggttcctcggaggatccagtttgattctactctttattttgctaaataaactcggtctgctttgtcccttgttaagaatgagctttgagttttctgtagtgcaattgttgtagcttcgcatgttttcatatgggaattacgttcctaaagaccgtatttgccacttggaagcagcaaactgcttgaacttcttggagattggacgctggtttgtttcttggttcgg

SEQ ID NO: 17204 - DNA, 645 bp, Zea mays
  Clone ID: LIB3279-215-Q6-K1-C9
cccagcgtccggcacgacggcaccaccgtggtgctgtgggagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgccttccacggcgacaaggaccacggcggcgtgcgcgacggcaccaacatcgtgctctggaagtggtgcgagggcgacaaccagcgctggaagatcgtcccctggtaaatgtgctgttctgtggctgcactggtcatcaccatg

SEQ ID NO: 17205 - DNA, 599 bp, Zea mays
  Clone ID: LIB3279-215-Q6-K1-D10
cacaaagcagctcaaaaacccacacacctcaacaagcagagcaaagacccgggattcgccggcgcggtagcgagagcgagagatggacgggaggatgttcggtctcgagacccccctgatggtggcgctgcagcaccttctggacgtgcccgacggcgacgccggcgcgggcggcgacaaggcgggcggcggcgggcccacgcgcacctacgtccgcgacgcgcgcgccatggcggtcaccccggccgacgtcaaggagctcccgggcgcgtacgcgttcgtggtggacatgccggggctgggcacgggcgacatcaaggtgcaggtggaggacgagcgggtgctggtgatcagcggcgagcggcgccgggaggagcgcgaggacgccaagtacctgcgcatggagcggcggatgggcaagttcatgcgcaagttcgtgctgccggacaacgccgacatggacaagatctcggcggtgtgcagggacggcgtgctcaccgtgaccgtcgagaagctgcccccgcccgagcccaagaagcccaagaccatcgaggtcaaggtcgcctgaggtgggactaggtcgaccgatcgtggctctg

SEQ ID NO: 17206 - DNA, 467 bp, Zea mays
  unsure (1)..(467): unsure at all n locations; Clone ID: LIB3279-215-Q6-K1-D11
gcagactggtttaggtggtgtcggaaagttgggcgccttcggcttccgaagtcctcaaaaacatgatttaacaatgcctctggagtataatgtgtggacagggatcttcgaacaagagcccacggtatgaagaagcacggnaaataatacgaaagatggagcagagccgaagctgcgcagaagggagcttcggcatgatggcagaaaagaggaaaccgacttaaagaggaaaagactatctagacccagataaattactatagagttgttgtcataggcaaagggcctggatgtaattttgcatgggctgcgacccgtgcctataaataggtgaacagtattcccgtactgttcacgctgacttggcatctgctttcgcgtcacgcttgtacccttgctttccttcgagccgaaggtatatttgtaatttgttattgttaatacagtaacgaaaataaaaatnnntt

SEQ ID NO: 17207 - DNA, 636 bp, Zea mays
  unsure (1)..(636): unsure at all n locations; Clone ID: LIB3279-215-Q6-K1-D8
gngggcggnggcattcatcgacagcttcaggcagcagcagcagcaggtgcaccactaccaggaggaggaatacgtcccgcctccggcgcccgcgccgccgctgtcgcgcacgtcgtccgtcctggaccgcctccgctccttcggcttgtaccgcttccgctccggcgacctcggccccgaccttccctccgccgccgccgccgccgccacggagacggacaagaaggagaagcagcaggaggcgcactacgggcggagccggtccgagccggcgcgggagcagggcaagaagcaggacgcgaggatgaacaagtcgagctcgagcggcgtcgtggctgaggcggaggcggaggcggaggcgcatcagtgcgtgaacgcgcgcgcggacgacttcatcaacaagttcaggcagcagctacagctgcagcgactgaactcgctgctcaactacaaggagatgctcaaccgcggcggtgacaagcagtagccggagcgtgcaaggcggagggagaagggtagctagctgtaggatccaatccaaaaccatactgaaaaaaaaaatcgatctttggtccatcaaccactagacctcgagtgtggattatgcagtgttgttcttattagcatcgttatgta

SEQ ID NO: 17208 - DNA, 652 bp, Zea mays
  unsure (1)..(652): unsure at all n locations; Clone ID: LIB3279-215-Q6-K1-D9
ngatatatcgcatctgacgaaactgccaaattaaagattggattatcactatctgtggataattcacaatcaatgaaagcggacgagttcatagcaaaaagagctatggaggcagttggagctgctgaaacacgacatggagagtggtcagtaacaagattacgttctgctgcacatggcactgcttatattgagagcttaagtttgggtgttggaccaaggggtgggcttggagaacagggcgattctgtctcttgtctgcttgttcttacaagcacttcacttgttgaaagacgtccagagaactatgaggctgtcatagtacgaccactctcagcagtaagtgctcttgttcgatttgtagaagaaccacagatatttgcatttgaattcaatgatggctgcccaattcatgtatatgcaagcacttcccgtgataatctacttgcaacagttcttgatgttttagaaacccagagacagtgtgcaattccagtgctaccaaggttaacaatgtctggtcatcgcatagatccgccttgtggggtagcacatcttgagatgccctatcatggttctgttgacatggagtcagcttccatgcacacaaaacatttggccgcaattgctaaagaggctgtagtgtcatctg

SEQ ID NO: 17209 - DNA, 328 bp, Zea mays
  unsure (1)..(328): unsure at all n locations; Clone ID: LIB3279-215-Q6-K1-E10
ngagagtctcccngaaacctgatcctgagatgagaagaaagcctaaagcagagtgggatgccgcggtgaggactgaggactgaggactggacgcgcggcgcgggtgcgcggcttcggagtccgctagactacaccacgcgggttcggcaaatggggatggcggcggacgcgacgacggccatgaccatcgacttcctccgcgcgcgcctcctctccgagcgctccgtctcccgcgccgccaaggagcgggccgaccaccttgccaagcgggttgtggagctggaggagcagctccggacggtgacggcgcagcggcgcaaggcggagc

SEQ ID NO: 17210 - DNA, 644 bp, Zea mays
  unsure (1)..(644): unsure at all n locations; Clone ID: LIB3279-215-Q6-K1-E11
gnacatggtgaaagtgaagctgcactaaacagccagtctaaaactcgattgattgggccaaattgccctggtatcattaagcctggtgagtgtaaaattggaatcatgccaggttacatccacaagcctgggcgtattgggatcgtatctcgttctggtactttgacatatgaagcggtgtttcaaacaacagctgtaggattgggtcagtcaacttgtgtaggcattggtggtgacccgttcaacggcacaaattttgttgattgccttgaaaagttcgttaacgaccctcagacagaaggtattgttctcattggtgaaattggaggtacggctgaggaggatgctgcgacattcatccaggaaagcaaaacacaaaagcctgttgttgcattcattgctggacttacggcacccccgggccgtcgcatgggtcatgctggagctatcgtggcaggaggaaagggtactgcccaggacaaaatcaaggcactcagagaggcaggtgttaccgttgtcgagtcaccagcgaagattggctctaccatgtttgaaatcttcaagcagcgtggaatggtagaatagacgatggagacattgagaaaccgcattttgatgctcatgggcaattgcgagcaattcct

SEQ ID NO: 17211 - DNA, 405 bp, Zea mays
  unsure (1)..(405): unsure at all n locations; Clone ID: LIB3279-215-Q6-K1-E7
caagaccaaaaccccaatcgcacagnagagaccgagagagaggttttccatccatggctcccggcgtcgcttccgtgctggtcccgcaggagcccgtcctcctcagggcatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggagggatggcnngacgc

SEQ ID NO: 17212 - DNA, 651 bp, Zea mays
  Clone ID: LIB3279-215-Q6-K1-E8
gcaggaacagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactataa

SEQ ID NO: 17213 - DNA, 614 bp, Zea mays
  unsure (1)..(614): unsure at all n locations; Clone ID: LIB3279-215-Q6-K1-E9
cccagcgtccgcggccgcgtgggcgtcaagnatcagctggtttatggggacgatagcttctgctcaggttgctgacccaatcagatggccaaattcaccgtggaggcttcttcaggtgtcatgggatgaaccagacttgctgcagaatgtgaaatgtgtcaatccatggcttgtggagattgtatcaagcattccaccgattcacctagggacattttctccacctagaaagaagttgcgggtggcccaacatccagactttccatttgagggtcagctgttgaatccaattttccatggcaacccacttggtccaagcaacagcccacttcgctgtttctcggacatcgctcctgcaggcatacagggagccaggcatgctaaatttggtttacccctaacagactaccagcttaaccagctgcacctcggtttcaaccggcttggtgctatgactccgacgtcccgtatatccaagggttttgtgatcagcagcgcaccagccagtgagagtgtctcttgcttgctgacaatcggcacaccagaggccacagagaaatctgatgacgtaaagagaccccacataatgctgttcggaaagcctatccttactg

SEQ ID NO: 17214 - DNA, 628 bp, Zea mays
  Clone ID: LIB3279-215-Q6-K1-F10
ccgggcggcggcgctcgggccaggccacggccacgaggcggcgtgcggcctgccggccgagccgacggtgcgcctcgtcggcccggaagggaggtgcgtggacgtgccttacggctactactacaacggcaaccaggtgcagctgtggagctgcaagtccaccagcgccgtgaaccagctctggacgctcaagagggacggcaccatccggtccaacggcaaatgcctgaccagcagcggcgacgcggccggcgcccgcgtggtggtcgacgactgcccgcgcttccccacgggccgcgtcgtctgggaggtgcgcgtggacggtaccgtcgcgctcaagtggtcccgcggcctggtgctggccgtgacctcgtcgacgctcttcgcggggctcacggtgcggcaggacgaccgcggcaccggccagtcgtggacgccgaccaacgtcaccgcgcccctggacgccgccatcgtggggttccgcgacctctgcctgcaggcggactacgcgggggcggtatccgtcgctgcctgccgcgacggcttgcagtggtcgctctaccccgacggctccgtacgcccgcccgcgtggctcctccttcaatggcagtgcctggctgctgatgcc

SEQ ID NO: 17215 - DNA, 653 bp, Zea mays
  unsure (1)..(653): unsure at all n locations; Clone ID: LIB3279-215-Q6-K1-F11
cgatcccgtgtctggttcgcgcgatggcgngagagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgccccagcgttgacgccgtcgagtctgccgtcaagggcgtcgttagccccgtctacgaccgcttcggcggcctgccgctcgacgtcctcgccttcgtcgaccgcaaggtggacgacacggtgcacgaggtggacaagcacctcccgggcgcgctgaaggcggcgtcggcgcatgtctacgcggtggttcggggcgtgccggaggtggcgcgcgagctggcggccgaggcgcagcggtcgggcgtgaggggcgcagcccgtgcggcgctcgcgatgacggagccggtggcgcgggacgtgtacggccgcgtggagcccgtggccaaggacctctacgtgcggtacgagcccgcggcggagcacctggccgtctccgcctggcgctcgctgaacggcctgccggtgttcccgcacgtcgcggagatcgtcgtgcccaccgccgca

SEQ ID NO: 17216 - DNA, 626 bp, Zea mays
  unsure (1)..(626): unsure at all n locations; Clone ID: LIB3279-215-Q6-K1-F7
gntttatataaacggnagcaaccattgccttcactggatgccatatatttcatccaaccaactaaagagaacattgtcatgttcctatccgacatgtcaggaagaagccctttgtacaagaaggcatatgtgtttttcagttctcccgtacataaagaattagttgctcaaataaaaaaggattcaagtgtactacctcgtattgccgcacttagtgagatgaatttggagtactttgctattgattcccagggtttcataactgaccatgagagggcattggaagaactttttagtgaaaatgcagaaggatctcacaagtataatgcttgtctgaacacaatggctactcgtatatccacagtatttgcatcaatgagggaattccctcgtgtacactaccgtattgccaagacgattgatgcttctacaatgacaacactacgagacttagtccccacaaagcttgctgccagtgtatggaattgtcttgcgaaatataaaacgacaatacctgaatttcctcaaacagaaacttgtgagctacttatagtagaccgttcaatagatcagattgcaccaattattcatgaatggacttatgatgctatgtgtcatgatctgct

SEQ ID NO: 17217 - DNA, 606 bp, Zea mays
  Clone ID: LIB3279-215-Q6-K1-F8
gcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatttctctgtggcaaacttcccgtcctgcatggggttgtaagctgtctctaaatttcacggcaagtcgtgtgcctgaaccttcatcttaagttgttgtcgt

SEQ ID NO: 17218 - DNA, 286 bp, Zea mays
  Clone ID: LIB3279-215-Q6-K1-F9
tggcagttgtccagaaaggccttccatgaaagatttcgagttgtgtgatgttttggagttttggatcctgcattgaagattacgataacgtccaatgacatgatcttgagctgttacattttgggagtttgaaatcttgcgtatattttggagtttgagatcctgcattgaagattgtaatttcctccgtgcaaattaaggacctaggcttctccaagatgccggtgttgcttcttctacacttacattgttacattttctggattaagacatgttagcttccatt

SEQ ID NO: 17219 - DNA, 629 bp, Zea mays
  unsure (1)..(629): unsure at all n locations; Clone ID: LIB3279-215-Q6-K1-G10
ctntaacttgaagtctgaagccatttcaacttctcagctaagggctcagatgacttgccctatgagtttgacattgagctgtttgatgctgtgaatgtggaggagagcaaagcagctgttgccccaaggaccatatgctacctgataaagaaagctaagagcgggtggtggccaaggctgctgaagcaggagggcaagccacctgtgttcttgaaggttgactgggacaaatggcaggacgaggatgatgaagatgctggatttaatgactttggtggtatggacttctcgaaactggacataggaggtgctgatgacgacgatatcggggatgatgaagatgatgtggttgaaagtgctaacaaagatgaagaaggaggtaagacagaagagagcaaggaggaggaagcagctcctgcggctgcagaggaagtgaagccatgaagaatcatttgactttgctccgcgccatgggtgtccacggtatctagctaggctagacgttcccttggatttttggtgtaaaatctggaggtcgaaccactcactgcctattgaagtaaaggatacaaaaacagttgtgctgtcttagtttttggctgaaccctgtgaactgctgctacaatatt

SEQ ID NO: 17220 - DNA, 629 bp, Zea mays
  Clone ID: LIB3279-215-Q6-K1-G11
ggcgaactgccatggacctggtgggatccttgctcctgagcatggcacgtctgcttgacccatccggtctccacttcgtgggctggctcgtcaccgcgggctccattggtcttgccgcactcatctacgctctcctcaggctgcagcgtgaggcggcgttgtactggaccaaggcgaccagggagaagcgtgccgcatggaggagattgcggtgccctagctcctgccactcgtggtctgaggactacttccacggtggccagccatcgacatgctgcgtttgcctgtcgtcccttggctccacgcagggcgtcgacatggttcaccgctgctctgtttgcggcgtggctgcacactcaaactgctctccccgtgcagagaaggattgcaagtgcgttgcacaggctggcgcttcgcccttgctgcatcactggtctgagaggtgggtggagctggatgacaacccggagatatcctcctcctgttactactgtgatgagccgtgcggtgtgcctttccttggagtctctcctatatggcgttgcctgtggtgccagcggcagatccatgttgattgccatgcaaaactgttgaaggaaaccggaaacacttgtgatcttggccttctc

SEQ ID NO: 17221 - DNA, 619 bp, Zea mays
  unsure (1)..(619): unsure at all n locations; Clone ID: LIB3279-215-Q6-K1-G7
ctaattgctgctggtagaacatttganacagtcctgcaatcagaaaggctgcagctttctgttatcaaaagagcttccttccggtggctggggagaaagctatttatcgtctcaagaccaggtttacaccaatctcaaaggcaaccgagctcatgcagcgaacactggttgggccatgctggcgctgattgatgcaggacaggcccagagagatcccgcgcctctacaccgagcagcaagggttttgataaacttgcagtcagaggacggagaatttccccagcaagagatcataggagtgttcaacaagaactgcatgatcagttactcccagtacaggaacaccttcccgatctgggctctgggagagtaccggtgccgagtcctgggggctgctggcaagcggtagtgacccggcctggccccgtcaacttgactgaaaggcgctttgttgtcttggcgttctatctcggcaacgccgagggctgtcttgccggccgcctagctgtctcatgaatcaatcagcttttttgtgagtagctatgcgcggtagttggaaattggaataatgcagctatgcttttttttagggttgcgctcctagttctaataatgtact

SEQ ID NO: 17222 - DNA, 643 bp, Zea mays
  Clone ID: LIB3279-215-Q6-K1-G9
gcggcctgcccacgtttgccacagcctacggcggtccggccgagaacatcgtgcacggcgtgtctggctaccacatcgacccttaccagggcgacaaggcgtcggccctgctcgtggacttcttcgacaagtgccaggcggacccgagccactggagcaagatctcccagggcgggctccagcgtatcgaggagaagtacacctggaagctctactcggagaggctgatgaccctcaccggcgtgtacgggttctggaagtacgtgtccaacctggagaggcgcgagacccggcggtacctggagatgctgtacgcgctcaagtaccgcaccatggcgagcaccgtgccgctggccgtggagggagagccctccagcaagtgatgcgcgacggcggccacagacctgatcgatcgatgagcgagagggagcactcggagtgtcgtgtcttttcccttgccatttctttctttttttcccttcccggaggcgaaaaaaagagtctgcttttgctaggcggcgggcgttcgttgctgctctttgcttcaagagttaaatttacctaccttgtcaaggtcttgttccatcattgatccgggtgtcgcttttttagtagtctgatggactgttagtagtttgcgttg

SEQ ID NO: 17223 - DNA, 628 bp, Zea mays
  Clone ID: LIB3279-215-Q6-K1-H10
caagtttctcctcgatcctcatctcctccctctctcgagtcaagagcagagcagctaccaaacaagctctcctttcgcttccgatccatggagctcgacgccgacaacctgagcgccaccgagctccgcctcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgccgcgcctcccaaggcgcaagtggtcgggtggccgccggtgagggcgtacaggaagaacaccttccaggcggcggcggcggccaagaaggtcgagcagaagcagaagcagcagcagcagggaggcctgtacgtgaaggtgagcatggacggcgcgccgtacctcaggaaggtggacctccggatgtacaaggggtacagggagctcagggaggctctggacgcgctcttcaccaactccttctccgcggcggcagagggcggcggcgaccaccaccagcacgccatcgcctacgaagacaaggacggcgacctcatgctcgccggagacgtgccct

SEQ ID NO: 17224 - DNA, 641 bp, Zea mays
  unsure (1)..(641): unsure at all n locations; Clone ID: LIB3279-215-Q6-K1-H11
ctccctttccccttccctccctccctctccccgcgggccgccagnagcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctcg

SEQ ID NO: 17225 - DNA, 641 bp, Zea mays
  unsure (1)..(641): unsure at all n locations; Clone ID: LIB3279-215-Q6-K1-H8
cccgnaaaccttgtcccatttccttccatattatttacatataccctctgtccttgaagcggcgatgctctgttggtaatcttggaggcgatcgatgtcgacaggccgtgacgtcgtccgatgattctccctctccctcgtcgccttcgttgtcatcttcgcacggcttgaaggttgaagcagctgctcccgcagatggcggcggtgtggtctaggatcgggaggggagcgcagctgtcgctgtcgctgtccctgtcgaggaccttctacgacggcgcgtcggcggcttccacgctgcgcagtgctgctgcgctgtcccgcgcccggggccagcacgcgtcgtcgctccacagcctcgcgggaaggtccgccggccagctcctccagccgccgagcaggggcatcgtgaccacgcccgcgaggcttcacccggcgtcgtccgcggcagtggtggcagagctctcggacgcggaggcgagggagtccgaggccgtggcggcgccgcctcgccagatgccgagcctcggcccgacgcggcccggggagaagccccgcgtcgtggtgctgggcaccgggtgggcggcgtgccggctgctcaaggacgtggacacgcgcgcctacgacgtcgtgtgcgtgtccca

SEQ ID NO: 17226 - DNA, 60 bp, Zea mays
  unsure (1)..(60): unsure at all n locations; Clone ID: LIB3279-215-Q6-K1-H9
ggggggggggnnnnnggnagggggggggagggggggggngggggggcgggacagcggggg

SEQ ID NO: 17227 - DNA, 627 bp, Zea mays
  unsure (1)..(627): unsure at all n locations; Clone ID: LIB3279-216-Q6-K1-A10
cagnagtggggaggtatacaatttcctctccttttggaagagtactcagccctacagaaagtttcatccatgaactagatgagaagacaagtgcctctctgagttccggttttgaacccgaaggtcgcatctggaccatggtcgctggtggtggtgctagtgtcatttatgctgatacagttggagacttgggatatgcatcagagcttggaaactatgcagagtatagtggtgctcctaatgaggaggaggttctgaattattctagagttgttcttgattgtgcaactgctgatcctgatggccgcaagagagcccttctcattggaggtggcatagctaacttcactgatgttgctaccacattcaatggcatcatccgagccttaagggagaaggaatccaagttgaaggcttcaagaatgcacatttatgtccgccgaggtggtccaaattaccaatctggactggctaaaatgcgtaagcttggtgcagaactcggcgttccaattgaggtgtatgggccagaagcgactatgactggaatctgcaaacaagcaattgaatgcatcatggctgcagcgtaatcagagcgtagctctgggtagtttgggatctgcaaacacg

SEQ ID NO: 17228 - DNA, 587 bp, Zea mays
  unsure (1)..(587): unsure at all n locations; Clone ID: LIB3279-216-Q6-K1-A7
gggagaatcagatccaacacatccgcatccctctctcctcggtttcctctcccaccaccaacccccanatcgcagcgatctccgccgccgccctctctgggattccgcgcgacaaagtcaggcgtagaggctccaggaggaggagggaggcgcagcagggcgggtgggggagatgttcctctgggactggttctacggggtgctggcctccctcggcctgtggcagaaggaggccaagatcctcttccttggcctcgacaacgccggcaagaccacgctgctccacatgctcaaggacgagcggttggtgcagcaccagccgacgcagcacccgacgtcggaggagctcagcatcggcaagatcaagttcaaggcgttcgacctcggcggccaccagatcgcgcgccgcgtgtggaaggattactacgcaaaggttgatgctgtagtatacctggtagatgcatatgataaggagcgatttgctgaatcaaagaaggagctcgatgctctcctgtctgatgattctttggccaatgttccatttctcatccttggcaacaagattgatatcccatatgctgcctctg

SEQ ID NO: 17229 - DNA, 631 bp, Zea mays
  Clone ID: LIB3279-216-Q6-K1-A8
agacccgctctgcctaagaatttatgaatgccttcttcctgttcattcttggtttatgccaatcaagaactacaagggaatccccggaatccactgtttgctagctgtttgcttttttaggcgtgcctgccactaaatcgtgtttccatcgtcgttggtagatgccgggagaagcagcgcaaggagtcctctcgtctacaaaccgtgaaccggaagctgagtgcgatgaacaagctgttgatggaggagaatgaccggctacagaagcaggtttcccgtctcgtctttgacaacgggtatatgaagaatcgactccacagtccttctgtagccaccaccgacacaagctgtgagtccgtggtgacaagtggtcagcacaaccaacagcaaaacccagcagttctgcatcctccacaaagggatgcgaacaacccagcaggtctactcgctattgctgaggagacattggcagagttcatgtccaaggcgactggaactgctgtcaactgggtgcaaatggttgggatgaagcctggtccggattccgttggaatcatcgctgtttcgcacaactgcagcggcgtagcagcacgagcttgcggccttgtgagccttgagccacaaagttgct

SEQ ID NO: 17230 - DNA, 532 bp, Zea mays
  unsure (1)..(532): unsure at all n locations; Clone ID: LIB3279-216-Q6-K1-B10
atctggncgaggccaaggnagatgaagctcgcggggctcaagtctgtggacggcgcccacgaggagtccatctgggcggcggcgtgggcgcccgccgctgaccaccgccccacggcggtgctcctcactggcgcgctcgacgagaccgtccgcgcttggctccccgacgacctcgctgccttggggtcccccacgcggggccacgcgctcggagtcgtctccctcgccgcccaccccgccggcgcgctcgccgccgccgtgtcgctcgacagcttcatccgcgtcttcgacgtcgacacgggggcatccgtcgccacgctggaggcgccgccgtccgagatttggggcgtccagttccatcccaaggtgaaatggagaagggtggaagaaggacaaagatgaaagaagaaggaactgagatgataaaaatagggtcgcagaaagaaataagacgaaaaaactttcttgtttatttgtactgaaaatatgtaacactctctttggatttaataaagtgtgtcaactttagacg

SEQ ID NO: 17231 - DNA, 611 bp, Zea mays
  unsure (1)..(611): unsure at all n locations; Clone ID: LIB3279-216-Q6-K1-B11
tgnagacggnctatcgccagtggcgatcaccctccctgtcccctgaccgcggcgtcccctgctcgcgccgcaccggtggcgacaaggcaccccttgcctgctcccctagacgcgagcgagcgagccaacacctgtcggcacaagaatggatgggaatgctgagacgatccaattctcatggggcaagcgtcgagggaaaggtggtgctaagatggatacacagttctttgggtccttcacattggacaatgtgaagtattcactgtttgactgtgtctatctatttaagcatggtgatcctgaaccgtacattggaaaaatagtgaagatctggaagaaaggctaccaatatatatgtagcgtcagtcgtaggatcctggtagacatatttgtgcgttgttggtctgtcaagtcggtgcgcgtcacattgtaccgggtggtttctgtccgagtatgtcttgaacagcaaaacttggttcatttatcttggtatttttcaaaaaaaaaaaaattnaaaaaaaaaaaaaaaaaaaaacccccnnanaaaaannaaaannnaaannnnnaaaaaaaaaaaaaaaaaaaaaaaaaaaaaaagggcggccgtttta

SEQ ID NO: 17232 - DNA, 321 bp, Zea mays
  unsure (1)..(321): unsure at all n locations; Clone ID: LIB3279-216-Q6-K1-B8
tccggttcttaaatcgcgaagcggcccgcccgcgnatctagnnatcaggtggnnctgctgnnggtgatgagnatattgaagaaccctaggnnggttcatttgnnttgggttccatttaaactttgtagaaagccttnngttctctcttaaaatgggagcaatcaggnaatcatctgtaaaggggtatcacggnaatnntagctgcannggtttcaaagcttgtacccatgtgtgtctatttaatgaccctatgtaanngcaagttaccaanncgacgtgnnccaatgcaatnnaaactgagtatantcanncagtggaccc

SEQ ID NO: 17233 - DNA, 636 bp, Zea mays
  unsure (1)..(636): unsure at all n locations; Clone ID: LIB3279-216-Q6-K1-B9
nganaaaacggcggcgcgggcggacaagnagcaggcggaggaggagttgtgccaagccacaatgggtatctcgcgtgactcgatgcacaagcgccgagccaccggtggaaagcagaaggcctggaggaagaagcgaaagttgagcttggtcgccagccagccaacaccaagttgtcaagcaataagacagtgaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggc

SEQ ID NO: 17234 - DNA, 606 bp, Zea mays
  unsure (1)..(606): unsure at all n locations; Clone ID: LIB3279-216-Q6-K1-C10
cggccgcgtgggttctacctcaagnatggtaagcatggccatgccaaatgccactttgttgccatagacatattcaacgggaaaagctcgaagaattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaggatgttggccccaagtaacttccctgccttggaatactgtatctcaaaacctaaatcgaaaaaagaagtgtatcaaggattgctacagagacatccatctggcttgagctggcttttgctatggcaaacacaagtgcagggatcgctgggtgttgcaccgtgtctgcattatctgtggttacattctggaccctgtattttctatggttntatgccccctactgtttagtattaattatcaataaatttgtttgggacggttgaattgc

SEQ ID NO: 17235 - DNA, 637 bp, Zea mays
  unsure (1)..(637): unsure at all n locations; Clone ID: LIB3279-216-Q6-K1-C11
gnaacaagtcaacacaacgccccaccaccccgaatcccaaacgnaagagggcactcggcgaggcaggtggcgattctgctgtcaccttccgtcgtctccatccccttccatttccggcgagggtcaaagcaggcctcttgctcttgggggtggtttgagagagggagagaacatggccgcggcggcggtgttggtggtactcacggtgtcagcgctggcgggggcagcggccggcggtgatatcgtccaccacgatgacgaggcacccaagatccctggatgctccaacgattttatcctggtaaaagtgcaaagctgggtcaatggcaaagagggtggcgagtttgttggcgtcggtgctcggtttggtccaaaaatcgtctccaaggagaagcacgcaaaccgaactaaactcacgctggcagaccctatggactgctgctctcctccgaaacataaggttcctggagatgttcttttagttcaaaggggaaagtgcaaattcacaaagaaagcaaagtttgctgaagctgctggtgcttctgctatagtaatcataaaccatgtccacgaattgtacaagatggtctgcgaaaagaatgaaaccgatcttgacataaatatacctgcagttctc

SEQ ID NO: 17236 - DNA, 386 bp, Zea mays
  Clone ID: LIB3279-216-Q6-K1-C7
gctgcttgacggttttgactcggttcatggtgtgcagctctatcagatagagagctgacgtgaggtgtgagacgcggatcgtggagtactactcagtaggagaggtggggagggggaagaaggcgatagccggggaggatggtgcttgtgcttgcgctgggggatctgcacatcccgcaccgggcgcccgacctccccgccaaattcaagtccatgctcgtgcccggcaagatccaacacatcatctgcactggcaatctctgcatcaaggaagtccatgacttacctgaaaagcctttgccctgatctccatattaccagaggtgaacatgatgaggatgctcgatacccagagactaagacacttacaatttgtcagtttaagc

SEQ ID NO: 17237 - DNA, 433 bp, Zea mays
  Clone ID: LIB3279-216-Q6-K1-C8
tgtgcatgcaccacaattgcaacattgacgatggagctcaataccaccacacgtgatgtcatggacgaagttgtcgtccaagcacatgatgattattctttcctcgctcatcgatcgatttttgtatattgtgtttttcttggtggttccctcattgcttggaagattaagaagcagttagcagtttccctgtttgagtacagaggttgagttgtgtgctattcctcttgctacggtagaggtgacttgggtatggtggttgcttgttgattttggtgtttctgtgtctatattgacacccctttgtctagcagtattggttctattagtacttcttgtgatccaataatcattattggttctattagtattggtcgtgatccggtaaagcatgagcttactaaacatattaaacatattggtgtttatgctt

SEQ ID NO: 17238 - DNA, 642 bp, Zea mays
  unsure (1)..(642): unsure at all n locations; Clone ID: LIB3279-216-Q6-K1-C9
cccagcgtccggttcatcactactgctgatggctcaagtgtaaaattctgggacgcgaatcactttggccttgttaaaagctatgatatgccatgcaatgtggaatcggcttcacttgaacctaagtctgggagtaaatttgtcgctggaggagaagatttatgggttcatgtatttgatttcttcactggtgaagaaatagcttgtaacaaaggacatcatggtccagtccactgtgtccggtttgcaccttgtggtgaatcatacgcatcgggttcagaagatggcaccattcggatctggcagcttagcccggctaatgctgatgacaatgaggtgaccaatgcaaatggcaagacaactgctggggtaaacgaagttacaaccaagatcgaaggcttccacattcccaaggaggggcagaccgaggggtaggatctcatgtgttttgtggtgcttgtggttcttattgcgaggagattgccatcagagctgcagtggtcattcagtttccctctgcggagtcatcatgtctgcgatccaagggtatcctggcttcatgagtcatcatccactggnggaaaaacaagcaagcaanatggtggtgggtttttggatggngccctcgctttgatagaacat

SEQ ID NO: 17239 - DNA, 363 bp, Zea mays
  unsure (1)..(363): unsure at all n locations; Clone ID: LIB3279-216-Q6-K1-D10
gtttcccgattgcattggtttatggtaaacagttcctccacagcggctatctgagtcacgtctggtgatgcagtgacgggacacgggattcattgtaatgcagtctgcacgatactactttttgactaggacaattgtggaagcccatattaggaattgattatgactttgtaaaatagcttgaaactagtgtcgtagcaccgtagcacggtatgttggtgtatcttatatatttttttggctgtttcatgtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcggccggttttaaa

SEQ ID NO: 17240 - DNA, 634 bp, Zea mays
  unsure (1)..(634): unsure at all n locations; Clone ID: LIB3279-216-Q6-K1-D11
gccatgagcgccgcctccaanagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctganaccaggaaccatcaggggtgatcttgccattgttgttggaagaaacatcattcatggaagtgatggcccagagacagcga

SEQ ID NO: 17241 - DNA, 531 bp, Zea mays
  Clone ID: LIB3279-216-Q6-K1-D7
gttttgttgagtttacaagccgtgcagctgcagaacgagttcttcagacatacaatggacaaatgatgccaaatgttgacttgacatttcggctgaattgggccagtgctggtgaaaagcgcgatgatactcctgaatatactatttttgttggggatttggctgcagatgttacagattacttgttacaagagacattcagggttcattatccctctgtcaagggtgcaaaagttgtgactgataaattgacaatgcgcacaaagggttatggatttgtgaaatttggtgatcctacagagcaagctcgtgcaatgactgaaatgaatggaatgccttgttcttccaggcctatgcgtattggtcctgcagcaagtaggaaaaatacaggaggtgttgttcaagagagagtaccaaattctcaaggagctcagtctgagaatgatcctaacaataccactatatttgttggtgggcttgaccccaatgtcactgaagataccctaaaacaagttttttctccttacggtg

SEQ ID NO: 17242 - DNA, 658 bp, Zea mays
  unsure (1)..(658): unsure at all n locations; Clone ID: LIB3279-216-Q6-K1-D8
cgtccgcgcccacaggcttagcccgcacggnagcgaaccacacgggnaaaagctgatgggaagaacagaaaatcaagaaaggcagttcctgcagcttcaaaatcaagtccggcttccaagaagagcaaggatgacgatgattctgatgaggacgagactgatgattctaacgaggacgagacagacgattctgatgagggtgagggtttgtctcctgaagaaggcgatgatgatgattcaagtgatgaagatgataccagtgacgatgaggaggaagacacttcaactcctaagaagcatgaggcaggcaagaagagagctgctgaaagtttcgtgctgaaaactcctctatctgataagaaagcaaaagttgccacgccgtcagctcagaagacaggtgtgccattgaacggactaacaaaactgtcgtcgaagattgtataggtgtgactctgttcaaggatagtcttgaggttctagaacagaagagtagtggtgtgcatcagtgtatctgtttacaggataatagtggttggttaggtgtgtgcagaaaaagttagcgttatggtttgtatgtgatacatattaactgtgccttggaatgttcatgtgttgtcctgatttcgtgtgaaaaaaaaaaaaaaaaaaaaggcggccg

SEQ ID NO: 17243 - DNA, 637 bp, Zea mays
  Clone ID: LIB3279-216-Q6-K1-D9
cctctccttccgtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgccgccggcagggagaagtttgcttcagtcccatgtggcggtggcggtgtggctgtcgcggcagctgcccctgctgctggcggcgctcctgcagctgaggcgaagaaagaagagaaggtggaggagaaggaagaaagtgatgacgacatgggcttcagcctcttcgactaagcttgtgcaatagtcaagaatattgtttttgagtcgcggaagcagaggggataaaaatcttagtcatgtttggactttaactttgttttatgttggaaagtacttgaaagacttttcctgtggtaattctaggcgtaggttgctgtgctggttggggtttactggtgaaccagagtttttctatcccactatgaatttgttacctcaagttacc

SEQ ID NO: 17244 - DNA, 558 bp, Zea mays
  unsure (1)..(558): unsure at all n locations; Clone ID: LIB3279-216-Q6-K1-E10
cccagcgtccngagaacaancgcaccatccagttcgtggactggtgcccgactggcttcaagtgcggaatcaactaccagcctcccagcgtcgtccccggcggtgacctggccaaggtgcagcgtgccgtgtgcatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggctgcgctcgagaaggactacgaggaggtcggtgctgagtttgacgagggtgaggacggcgacgagggtgacgagtactagacgctctactggcgcggcgtcgtcgggcttgtgtgccactgctatcctgtgatctgccctgagtggctcctatcgtgttatgtttctgtcggttcttatctatctgtcgttgtgtggtttacaacttacgttgtaagactttattcccccgctttgctactgggttattaagtttggcgttattgttttcttgatc

SEQ ID NO: 17245 - DNA, 635 bp, Zea mays
  unsure (1)..(635): unsure at all n locations; Clone ID: LIB3279-216-Q6-K1-E11
cggncgcgtgggcggncgcgtgggtcgttgcaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttggtaaaagactgatgattcgtgttgccaaacgacacaattcgtattttttttgtgtgccgtgtagaacacggtttgttgttattggaatggttcac

SEQ ID NO: 17246 - DNA, 637 bp, Zea mays
  unsure (1)..(637): unsure at all n locations; Clone ID: LIB3279-216-Q6-K1-E7
ncgccttctacggcgcctaccacagcaaccccgtcaacgtgggcatccacgagctcttcgtctggcccatcttcctcaccgcgctcatgctcctccacctcaccgccccctccacgcacgccgccggcatcagcgccgcggtctacgcggcctactacttcctcctcgaccgccgcgcgggcgcgctcgccgccctcctctgctacctctgctgggccgcaagcggcgccctcgctgcccgcctcggtttctctgttggatggaaggttgtattggtggcccagttgttctgttggattatgcaattcattggtcatggagttttcgagaagcgagcgcctgctctccttgacaatcttgtccaggctttcctgatggcaccattctttgtgctgctagagattcttcacacatttggcgggtacgaaccgtatcctggcttccacgacaaggtgagcaagttgattgaggaagcccggaaggaatgggaggacaagaaatcaaagaaatcctcatgagatatgcgtgaattaacggctctgaactgttggggtctgcctgctcgagatgacctcctggattggatgaatctattgcaaggatggttaccgaatactgatgctatntatgttgtata

SEQ ID NO: 17247 - DNA, 631 bp, Zea mays
  unsure (1)..(631): unsure at all n locations; Clone ID: LIB3279-216-Q6-K1-E8
cccagcgtccgcaaaatcctatgatctatggaagggttgatgttattgcccccgaacaatgcccaccagaggggaggcttcctgctgctggcccaccttcacccgcggaacatttgcgtgaagtattctacagaatgggcctgaacgacaaggaaatcgttgcactgtcaggagctcatacacttggacgtgcaagaccagagcgtagtggctggggtaaatcagaaacaaagtacactaaagatggtcctggtgcacctgggggacaatcttggacatctcaatggctcaagtttgacaacagctatttcaaggctatcgaagaaaggcgagatgaagacctcctaattctgcctactgatgctgtgctgtttgaggattcctcattcaagatctatgctacaaaatatgccaaggatcaggacgcatttttcgaggactacgccgaggctcatgccaaattgagcaatcttggggcaaagtttgacccgccaaagggtatctcactcgagtagttgtggatggaggtgactgaacaggaaggggtcatgtttctttgcgtgaccattttcgaaggttggcaaggaaaattattgnggttgaatgatagctccacaaattggattcaccg

SEQ ID NO: 17248 - DNA, 651 bp, Zea mays
  unsure (1)..(651): unsure at all n locations; Clone ID: LIB3279-216-Q6-K1-E9
cggncgcgtgggttttggagggtctttggttgaattatggttagagaaactgaaaagctccatgcacaggttgggaggtacaagagcccagatgagcaccctttcttttccaaggatctgcctgagccccagttgccacctatgcaatacccaagggttttgcatcccattgctgattctatcaatatcaacaaagagatttggacaatgtattttgatgaacttcttccaagattggtgaaagaaggaagtgatggtaatgctggatccaatgctctttgtgacacaacctgcttgcaggcactctccaaaaggatccactatgggaagtttgtggcagaggccaagtttcaagagtcccctgaagcttacacgccagccataatagcccaagaccgtgatcaactcatgcgccttctcacatatgaaacggtggagcgtgctgtcgaacacagggtggaagccaaagccaagatcttcgggcaagaggtgaacattggtgctaaggacaacggcagccaaccagtctacaaaatcaggccgagcttggtcgccgagctgtacagctacagaatcatgccgctaaccaaggaggttgaggtcgcgtacttgcttaggaggctggattgagtgtgtttacgtagctgtaaa

SEQ ID NO: 17249 - DNA, 395 bp, Zea mays
  Clone ID: LIB3279-216-Q6-K1-F10
gctgcttgtacgcagctgcggtcgcacatcatcatcatggcctcctgcgccgccgtcatccgcgccaccccttacatcctccatttcctcgcccgcgacggcgacatccaggaactcaagctcgatctgtaggcccgtccgttgcttccccacctccagaggtgctacaaaggcaaccgttagttcgaggccactgcaaggtactatggagttagtggctacagtgcctgcttaagtttctttgttgttccaagtttagtgacaaaactgacaatggtgtagcaactgggttgtgctgcgaccagtatttcgtttttgcctacctgtatggtctagtctttgtttgcactggtggatttgcagagatgttatcattcaacaattgttctgtggtc

SEQ ID NO: 17250 - DNA, 649 bp, Zea mays
  Clone ID: LIB3279-216-Q6-K1-F11
cgggcgcgtgggcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagtttagtttgtagtttcttcgcttcatcggcactcgaccgttgttggattgggatgtttagcctgcagtctgtacttgcccccagcatctatggtgcctg

SEQ ID NO: 17251 - DNA, 222 bp, Zea mays
  Clone ID: LIB3279-216-Q6-K1-F7
cggccttattgccttcgacctctgttattgaagtcatgttgatacagaattgggtttttttttttctaattctctgcaagtcagttgtggagacattaatttccagtattctgcacatgtaactgaccaaatcgtgaacacattgaggtccttgaggaagaagtgttgatcatggaatgtttttgcatctgattattttgtattgatgtcttgaattcttgc

SEQ ID NO: 17252 - DNA, 651 bp, Zea mays
  unsure (1)..(651): unsure at all n locations; Clone ID: LIB3279-216-Q6-K1-F9
atggcgcacggcggctacccacgccgcggcgccgccgtacgcaggcccaagtcctcggcctctgccgcagttgccgaccgcaagcggaagcggaccgccgccgccgccaagaccacctcccttaagaaccagatccgctccaccgagcgcttcctccgcaaggaccttccggatgagattagggttgctcaagagaagaaactggaagaactgaagaggcaacaagagcttcagaatcaacttgctgtccagcggacattacagtttagagatagaaagataaaattctttgagagacggaagattgagaggatgataaggcgactcgagaagcaacaacgttcaaatggtgatggtgtcaacaataatctgtcaaaattgcgagaagatcttgaatatgttagattcttccctaagaatgagaaatatgtctcgctgttcactggagggaacagtcaagatattgttcaagagaggaataaatggcgcaaacagatcaaggagaatctcatggctgctgcagcaaacggaaaagatttagaagagacagcaagcgatgacgataccttggatgtgagtgatgatgacttctttatgtctggaagttcaagtgatgaagaggctgatnatgagtggactgacaagagtgct

SEQ ID NO: 17253 - DNA, 613 bp, Zea mays
  Clone ID: LIB3279-216-Q6-K1-G10
cccagcgtccgggcctcgcgggtcgcaaaccgctctctgttgatttgggatttgggaggcgctcgagttttcaggtaaaccatatttatgaccaatggctcgtctaagcagctgctcgcaagtccactggagggaaggctcctaggaagcaacttgccaccaaggctgctcgtgagtctgcacccacaactgggggagtaaagaagccttatcgttaccgccctggaactgttgctcttcgtgaaatccgcaagtatcagaagagcactgacctgctcataaggaagcttccgttccaaaggcttgtcagggagattgcccaggatttcaagactgatcttcgtttccagagccatgcggtgcttgcgctgcaggaggctgcggaggcgtacctggtgggtctattcgaggacactaatctgtgcgccatccatgccaagcgcgtgaccatcatgcccaatgacattcagctggctaggaggatccgtggtgaaagggcctagattctctgtttacggctactgggagtggctccgtagtatggtttgcatctgttcgatgcttgcttttgtggaagtttacattagtgggtgttcgaattcgtaatattcat

SEQ ID NO: 17254 - DNA, 575 bp, Zea mays
  unsure (1)..(575): unsure at all n locations; Clone ID: LIB3279-216-Q6-K1-G11
gcgttcgcttcagtccacccagccagccagcaactgcaaggcagcacccaagacacgcagcgcaggcgcagcccagccagattcgacccgagttcgcgacgagagcacgagatggcgatgcggaccgcgctgacttccctccccgcgcgcctgcgcgcccctgcgccccccgcggcgacgggcgggcggcgcctcctcagcgacgggaaggggcgcgtgctcagcgaggaggagcgcgccaaggagagcgtctacatccagaagatggagagggagcggcaggagaagctcaagaagaggctcgagcaggagaaggccgactctgacaaggccaagcccgccgacaccgacaagaaggccgagggatctacctagctaggattggcatggcgctgttggaaggcaatcacgtttcgcatgtatccgaatccgatggtcagctttgtgaatgaataaattctgtaaaacgtcaacagcactggatatgctgttgcttcggttgcttgcatgttgaagttgaagacgacattcatattttgatactgctnnnnnaaaaaaaaaaaaanaaaaannng

SEQ ID NO: 17255 - DNA, 641 bp, Zea mays
  Clone ID: LIB3279-216-Q6-K1-G7
ctgggcaggcactccggcactggctccttccttccctttcccctgatccctcgtccagtcgtcctcctctgcccggtacagctgcgaagccggcactggctctgctctgctcgccagcagcaccgacctccactctacgtctccaccagcaaggcgagctcgcttttcactcccccaaatctctgaataaaaaatcgcgcaagcaacctcgctccaccggcctcccgcaagttcgttcgttcagtcaggtcaggtcccagcctacgcagcatttgacagcgcgaggcggttgcccagtcagtctggggtggacggctttgatttgcttcgaagggagtgagattggttgaagccttcgaccaaggttgtcaatggattctgggatttgggcatctgtttggagcttcatcaagttcctgcctttcttctttgcgcttctcctcctgggcatcatcaaaggtgctttgtttggcccatgggcatggcttgtcatgacaattggaatttccgcacttattctaggcttatggcctatgcatgtgatttggacatattactgcatcatcagaaccaagatggtaggaccggtcgtaaagttgctgcttcttattgttgcaactgcggttttggttatatggcta

SEQ ID NO: 17256 - DNA, 649 bp, Zea mays
  Clone ID: LIB3279-216-Q6-K1-G8
cgccgccatcaatggcgatgtcgcgcttcgggcgctccgggcagccggagaaccgcgaatctttctccatcctcgtcctcaacgtctccttccgcactacggctgacgatctcttcccgctcttcgatcgctacggcaaggtcttagacatctacatcccgcgcgaccacaggactggggatccgcgagggttcgcgttcgtgaggtacaattacgaggatgaggcgcgggatgccattgacgggcttgatgggatgaggtttgatgggcgtgcgctcatggtgcagtttgccaaatacggacccaatgctgaaaagattcataggggtagaattacagaagaaaatccaaagccaaggggtcgttgcagaagccgcagtccaagacagaggtatcgagaggattatcgggatagagactatagaaggcgaagccagagcagaagtagggagcgatatgaacaggccgggtacagagatggtgatcatcgtcgccataggactcacagtatcagtcctgattatgacaggaaacgtaacagacacagtggctctcctgtacttaaacgccccagtcatagcagaagtcgttcgcctcgtagggcacctcatgaaggaatacctagcaagcccagagatggccgcgctgc

SEQ ID NO: 17257 - DNA, 606 bp, Zea mays
  unsure (1)..(606): unsure at all n locations; Clone ID: LIB3279-216-Q6-K1-G9
gcccgttgtgctctctctctctattcgttccccgcctcaccccgagccagccgtctcgctagggtttcgccgccgccgccgccgccgccgccgctatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgnnnaaaaaaaaaaaaaaaannaaaann

SEQ ID NO: 17258 - DNA, 647 bp, Zea mays
  unsure (1)..(647): unsure at all n locations; Clone ID: LIB3279-216-Q6-K1-H10
cgggcggctgctggcgtggcctgctgcaagnagcaccagaggatctacgccgagtggttcgccctcgccgacccagatggcgacggccgcgtcacgggcgccgatgccaccagcttcttcgccatgtccacgctttcacgcgccgatctcaagcaggtgtgggcgatcgcggattccaggcggcaggggtacctcggattcgccgagttcgtcacagcaatgcagctcgtgtctctggcccaagcagggaacgagatcacacaggacagtctgaaacgtgaagacctgagcaccttggatccgcctgtgatggaaggtgttgatgagctactggctagatccaaggctgttgtgaagagagttcacccagatgacaatggcaccactcaggcccaagcaccttccatatatcactggtttggttcaaaatcagcacagaaggtgcagatgcctctgactgctgttacctctgtaattgatggcttgaaaagactctatgttgaaaaactgaagcctttggaagtcgcctacagatacaatgattttgctcacccattattgacaaacagtgattttgaagcaaagccaatggttatgctcttgggtcagtattcaacagggaaaacaacattcattaagcatctgct

SEQ ID NO: 17259 - DNA, 523 bp, Zea mays
  unsure (1)..(523): unsure at all n locations; Clone ID: LIB3279-216-Q6-K1-H11
cggccgcgtgggcggncgcgtgggcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctagctgattgatcctcccatatcgatcgtcgtccctccccgtttgctacgcgtgcgtgtgagagtgatatcgagcgccggccggcctgcacgcccgccgtgttgtgcgtacgtacgtacgtatacatgtatgtatgtatatgcgcgcgtgtgatgcacgaataagcgtggctacgtaatctatcgtatgtatacgtgtgtgtatgcatgtgcttgtgtatgatcgtggtacgaggaccgaaaaaagtatgcaactctgatttacttac

SEQ ID NO: 17260 - DNA, 640 bp, Zea mays
  Clone ID: LIB3279-216-Q6-K1-H7
cggccgcgtgggtgcccgcccgccgtcccgacggccatggcccgacccttctcttccccacacatcccgtcttcatcctgggtgactcgccgccctcctccctggacctcctcaccgtccttctccaccacgagaactagcgcctcgtctattaccgcgtgcagaccgcgccgcagggcagtcgcgccggcggcctccctccaccttggcccgggggagatcgccgagctcgcgcgcaacaaggttttgattgcggcgacagtggcgagcgcgatcgggcagctgtccaagcccttcacctcggtcaagaatgggggcgtcggcgccggccttgacctcaggaccgtcttccgctccggagggatgccctccacccactccgcgagtgttgttgcagttgctacttcgcttgggctagaaagggggtttgcagactccatatttggaatgtcagtggtgtttgcagcaattgtaatgtatgatgctcagggagtaagaagagaagtgggcaaccacgccaaggtcttgaacaggttttggatcctcaaagagaaggcacctctggagtattctgaagtggacatggcagctcctgagtttgtttcggtcaccgaggaagcgagctccaatgcgagcccct

SEQ ID NO: 17261 - DNA, 636 bp, Zea mays
  Clone ID: LIB3279-216-Q6-K1-H8
cccagcgtccgccccgcgtccgggattaatggcagcagccattttagcaatggtcccctcatatatttcaagatctgttgcaggcagctatgataatgaagctgtagcaatatttgccttgatatttacattttatctatatgtaaagacgctgaacacgggatcactcttttatgcaacactcaatgctctctcatatttctacatggtctgctcttggggaggctacacattcattatcaatcttatcccaatgcatgtcctcttgtgcattgtaactggtcgttattcttcgcgtctctacattgcatatgctccccttgttgtacttggaacgcttctggcggcattagtacctgtggttggttttaatgcagtaatgacctctgagcacttcgcatcatttctggtgttcataatccttcacgtggttgctcttgtgtattatatcaaagggcttttaactcctaggctgttcaaagttgctatgactcttgtcatatctgttggcttagctgtttgttttgcagtagtagccatacttgtcgcattggtggcatctagtccaacgaaaggctggagtggccgcagtttgagtttgcttgacccaacttatgcaagcaagtacatccccat

SEQ ID NO: 17262 - DNA, 629 bp, Zea mays
  unsure (1)..(629): unsure at all n locations; Clone ID: LIB3279-216-Q6-K1-H9
cggncgcgtgggtcgccngaagcacctgctacctcgcgcccgccttccgtcgcgcggattcggtgccgcgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgcggcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactccctc

SEQ ID NO: 17263 - DNA, 625 bp, Zea mays
  Clone ID: LIB3279-217-Q6-K1-A10
cggccgcgtgggcgcaactggtcttgctattgatgcttatggtcccatcagtgacaatgctggtggtattgctgagatggctggaatgagccacagaatccgtgagagaactgatgctcttgatgctgctggcaacacaactgctgctattggaaaggggtttgccattggttcagctgctcttgtgtccctggcgctttttggtgcctttgtcagcagagctggagtgaaggtcgtcgacgtcctctcccccaaggttttcattggtttgattgttggagccatgcttccctactggttctctgccatgaccatgaagagtgttggaagcgccgccctgaagatggtggaggaggtccgcaggcagttcaacaccattcctgggttgatggagggaacagccaagcccgactacgcaacctgtgtgaagatctccactgatgcttccatcaaggagatgatttctcccggcgctctggtcatgctgactcccctcatcgttggaaccctcttcggcgtcgagactctctccggtgttcttgctggtgcccttgtttctggagtgcagatcgccatctctgcctccaacaccggcggtgcatgggacaatgccaagaatacattg

SEQ ID NO: 17264 - DNA, 642 bp, Zea mays
  Clone ID: LIB3279-217-Q6-K1-A11
gcgttcggtattccgacaggacagcaggttgttcagcgatcactcgagcggtcgagccctcgcgcgcggagagtgtccagtctcaagtccagcggaggatggagagcggcttgcttgacaccgccgcggctgccggtctctgcccggtggcggccgggcgccgccgcgtcgggagcacggggaggggcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacggcggggtcgtcgtcgacgccgaccggctgccggccgacagggccgccttcgcgcgctccctcgcggcgtcgctctcctactggaagtccgtggggaagaaaggggtgtggttgaaattaccggtggatcgagccgacttcgtccctttagcagtgaaggaaggcttcaagtaccaccacgcggaggaagcgtatttgatgatgacgtact

SEQ ID NO: 17265 - DNA, 628 bp, Zea mays
  unsure (1)..(628): unsure at all n locations; Clone ID: LIB3279-217-Q6-K1-A7
tccggtccccgggccccggctcctcccctcccgattccaatctggtctcaccgggcctggcggcgagggagagatgggngaagaaccaggcgtacaaggcgatgcagcgggcgcggctggggtcctcgtccggcgcgccgggcgccgccgacgcccccgaagacggcatgacggacggttcattccattctccagagtggcatgcggcgcgcctggccagccttaacaagacgcacaccctcacctgggaggagttcaagaagaagcagaaggaagaggaactgaaaaggggtgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgcaaagaaaagaagtaaaaagaggagaaagcacaaaagttcatcagagtcaagttccagttcatcttcagaatcttcaagcagcgacgatgaggataggggttcaaggaagtccagatcacggtcgagatcgaagagaacaaggaaggaaaagaagagccggtcaaggtccaagcgcagaggcagtga

SEQ ID NO: 17266 - DNA, 397 bp, Zea mays
  unsure (1)..(397): unsure at all n locations; Clone ID: LIB3279-217-Q6-K1-A8
aattaattgtacacatccacattagcagcttataataattaatcgaccaacacagcactcaagctccctagcttagcttacaacagatccagcacataataacaccagagacacacggtngaaactgaactgaacacaacacagcacagaagacagcacatcaaatcctcctaattactccattaattaattgagcaacgacgacggcgacgacaacaattagatgaagcatggagaccaagcctaccaacattaacacggcagctgcagctgcgggacgaattgctacgccctaaccatcccatctcgcggcgggacgaactattatccccaagaagcgccgtcaagccgcggccgtctcgctgggcacggcggggcgtaccttggggggcctgcc

SEQ ID NO: 17267 - DNA, 204 bp, Zea mays
  unsure (1)..(204): unsure at all n locations; Clone ID: LIB3279-217-Q6-K1-A9
ggccacanaggaccagggcgcggngggagatggagaagagcttgtcggtgcggcggcttgaagatgaaggctgggcacgcgcgtagaagataaggccgctgaaaaaatcagagcaggagggcggcgggggatcaggtcgaggggatatttttcccttttttatttcttctttctttttttaacagagaatcacatatattttgg

SEQ ID NO: 17268 - DNA, 638 bp, Zea mays
  unsure (1)..(638): unsure at all n locations; Clone ID: LIB3279-217-Q6-K1-B10
gctcactcgctgctcgttgccggctgcccccgcccactccaccgctgatatttgtcatcgtctcgttcctgccctcggccctcccctcgctcgctccccaactccagcaggcagatcagatacatccattcgcggaccggaagtaatcatcaggaaaggaaggggcgttgaactatgagcgccgtggcggtttcgtcgtcgctgaacccggacgcgccgctcttcatcccggcggcgctactacaggtggaggacttctcgccgcagtggtgggacctcatcaccaccactgcctggttccgcgaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccggcagccccaagagcagcgccccccgcgtgatccaccagcctcgctaggttcgctgggggaactcatcangaaggctgctgcccctctt

SEQ ID NO: 17269 - DNA, 467 bp, Zea mays
  Clone ID: LIB3279-217-Q6-K1-B7
tcgggttcgcgtcgcagcgtcttccgcccgggctaccacaatgccgaagcagatccacgagatcaaggacttcctgctgacggcacggcggaaggacgcgcggtcggtgcggatcaagcgggccaaggacgccgtcaagttcaaggtgcgctgctccaggtacctctacaccctctgcgtccacgactccgacaaggccaacaagctcaagcagtcgctcccgccaggtctgactgtccaggagatttaaggtatcaagccgcaaactgtgcctttttttgcggtgtcagggacgtttgctccagtgtttactttagtatgtaggtgggctccattgctgtgtttgaatgaattatgaagtttgagtttgggatgtgaatgatgtgtcgaacctatgagcatgtggtgtaatggtaccccagaacgcaaaagatggcaatctatcataagttaaactgatttctgtg

SEQ ID NO: 17270 - DNA, 633 bp, Zea mays
  Clone ID: LIB3279-217-Q6-K1-B8
agcacggcccagagggcggcggacctatgggcatgccggttggccacccgcacatgggtattatgcagcagggcggcggtggcggtggtggtggcatgccgggcctggggttccacccgggattgggcggcggcggaatgcattctggggcggatatgcttcaggccgccgcggcatccgggaaccccgtggcgcagcagcagtacatggccttgatgcagcagcagcagcagcagatgatgatgatgcagcagcagcaacagcagcacgggaacggcggtttaggatacccggcggcaatgggctacggctatggccggccaccgatgcattacccaatgggctacccagtgctgcccccgcactcgcatgctgagccttacaacatcttcagcgacgagaacgccaacagctgctcactgatgtgatcagcaattccgcatggaatggccctgttccaagtaaaccatctcaaggagctcaatgtcaccgctgatcaccgacagacatcgccatggttgaagcgccgtgaatcaatcaacaatcagtatgcttggggatgagtcctagctagaaccctgtccctttcctgctccttccccccctttctctagcttattttcgccttgcttt

SEQ ID NO: 17271 - DNA, 643 bp, Zea mays
  Clone ID: LIB3279-217-Q6-K1-B9
tgcggttctgccgtctcgcctccaattggcctctctcccttgcaagtttaagcttcaccttcaaccatgggtaaggagaagtcccacatcaacattgtggtcattggccacgtcgactctggcaagtcgaccaccaccggccacctgatctacaagcttggaggcattgacaagcgtgtaatagagaggtttgagaaggaggctgctgagatgaacaagcggtccttcaagtatgcttgggtgctcgacaagctcaaggctgagcgtgagaggggtatcaccattgatattgctctgtggaagtttgagaccaccaagtattactgcaccgtcattgatgcccctggacaccgtgacttcatcaagaacatgatcactggtacctcccaggctgactgtgctgtccttatcattgactccaccactggtggttttgaggctggtatctccaaggatggccagacccgtgagcatgctctccttgcgttcactcttggagtgaagcagatgatttgctgctgcaacaagatggatgcaacgactcccaaatactccaaggcgcgttatgatgagattgtgaaggaagtctcatcctacctcaaaaaagttgggtacaaccctgataagattgcctttgtcccca

SEQ ID NO: 17272 - DNA, 623 bp, Zea mays
  Clone ID: LIB3279-217-Q6-K1-C10
cccagcgtccgggagtttcagaaattgctgatgagttcaagcaggaatattttggaatgaaaacgagtgatgaaatttctatttgtgaaattaagaaccacataaaacatgggaaccatcagtggaggagattgagggggaatattggcggatagtcataggccctgctgatgaagttgaggtggattatggtgctgatttggacactgcaacctttggtagtggttttgttaaattatcttcttcagatggaaataagcaagatccatatggtgtgtcttgttggaacttgaataatctgccacggctgcctggatctgttatctcatttgaggaagacgatatatctggtgttgttgtcccgtggctttatgtaggaatgtgcttctcttcattttgctggcatgtggaagaccattttctttattctttaaattatatgcattttggtgaaccaaaagtttggtatggtgttcctggtggtgaggcagtaaagctggaagaatctatgagaaaaaacttacccaaactgtttgaagagcagcctgacctacttcatgagctggttacacagttatctccatctgttctgaaagcagaaggagtttctgtttaccgtgctg

SEQ ID NO: 17273 - DNA, 590 bp, Zea mays
  Clone ID: LIB3279-217-Q6-K1-C11
acagaaaacataggacatctttggggttcgatacccacatacgaaaacaacaggacatcaattatcttgggtgcataccttggtttctcatcataattcaaaataacatttaaaatatgtagctagtacagaaaactcttttcgcgacacttggaacagtaaactaagacgttcaagcttccactgtctcggtgggagcctcgatcagaagaccctttgtcggcttagccaagaggtcggtgaactcctggaacggggtcttggcatacttggtctcggcccagaactcaggagtgaggaagccgtaggtcttcatcagacaatcaaaggttgccttgacgaagttaccgagtgtcttggtggagccacgggacgaggtaaagacatcttcaatgccggcgaactggaggaccttcttgggcacgcgggcagcgacaatcccggaccccctgggcgccggcaccatgcgcacggtgacggacccgcacttgccggtgaccttgcagggcacagtgtgcggctggccgatcttgtttccccagtagcccctcctgacgggcacgaccgagagcttggccaggatgatggcg

SEQ ID NO: 17274 - DNA, 138 bp, Zea mays
  Clone ID: LIB3279-217-Q6-K1-C7
cccgtagctgcctgcacgcatcacgtgagcggtgagcctgggtgggccactgcgtcggcgagggacggaactgcaggagcaggcatgcagctatgcgcacgctgacaattttattaaaaatctatgttggacggttgc

SEQ ID NO: 17275 - DNA, 284 bp, Zea mays
  Clone ID: LIB3279-217-Q6-K1-C8
ctcgccggcgcattcgccccggcgcctacctcatatcggaactgtatgatgtggagagcaaatgatggacatccctcgaagatgaggggataagttttcaggtagcaaaatttgattccatcgggattccagattgttggatgagagctgacatggcaattcagactaactagtgtgctatgtacccttatgttttctttggtcttgctattatgtttggcaaaaggatggaatggttgagcaaataaagtaattccagattgagaaatatttccagcgacggt

SEQ ID NO: 17276 - DNA, 596 bp, Zea mays
  unsure (1)..(596): unsure at all n locations; Clone ID: LIB3279-217-Q6-K1-C9
ccttccttcccgtctcttcttcccattccttccattcttgtccctgctcctgttggttttagcatcctgctcggccgaatgctggatcagaggctgcagcaaaggtagtaagtcgcttctcgtatttcccgtcgagagagggacagggggggagaacccccaaccgaggcgctgcaagttccccacggccggggcgggcttctcttgcgggaacatgaggaagctgttgttcatctccttcgtcctctcgctgtccgctgcagcagttcacggtgaagacggtaaggttcctcgcgctctctgttttgatccgttttatgcagttccggatgtgtttggccttttacgcgtgaatgcctgatgcatccatcttactcttcttgcttccgtatgcatggatggatcgatcgatctccacgttcgtgctcgctgcgttggttctcagctcagattttagtacgcctgcttcttgttttctcgttgcaatcatggagcatccacggagcgattgacagcagcggtcaagaattaaaaaaaaaaaaaaaaaaaaaaaannnnaaaaaaaaaaaaaaaaaaaaaaaaaaaagggcggccgc

SEQ ID NO: 17277 - DNA, 251 bp, Zea mays
  unsure (1)..(251): unsure at all n locations; Clone ID: LIB3279-217-Q6-K1-D10
ccccgcgtccgccccgcgtccgccccgcgtccgccagaattgtatctgtttatagaatgatggagattttgattcagtaagtagtctggagtctagccatccgagaccctcaataatctgtnacctggaaaccaaacagtgccaaataacttttacggagcgttatgtgcagctcatgtagaaaattcaattggaccgtatttcctgtcgtgtaccttctagtatcgtattatattatatatttattattc

SEQ ID NO: 17278 - DNA, 611 bp, Zea mays
  unsure (1)..(611): unsure at all n locations; Clone ID: LIB3279-217-Q6-K1-D11
gtaaaaaaaaaccanaaaagcagccacctccctccaggctccagctagcgtccgtccgtccgtccggccggccagcagcagcagcagactcgctcgctccaagccaggcgccggggcgcgcgatggacgacgacaagcagcagctggcgcggcaggaggaccaggcagggcgcgcgtcgtgggtccccggcgcggtcatcgtgggcgcgggcccgtcggggctggccgtggcggcgtgcctggcggcgcgcggcgtgccggccacggtgctggagatgtcggactcgctggcgtccacgtggcgccaccgcacctacgaccggctgacgctgcacctgccgaagcgcttctgcgagctgccgctgctccccttcccgcgcgggtacccggcgtacccgtccaagggccagttcgtggcgtacctggaggcgtacgccgcggcggcgggcgtggcgccgcggttcggcgcccgcgtggaggaggccgcgttcgacgcgggcgccggcgcctgggcgctccgcctggcgggcgctggcggcggcggcgccggcgacctgctcctggcgcgctggctcgtcgtggccacgggcgaggacgccgtgccgcgcctg

SEQ ID NO: 17279 - DNA, 614 bp, Zea mays
  unsure (1)..(614): unsure at all n locations; Clone ID: LIB3279-217-Q6-K1-D7
cgnatcggtgctngtggacggaaacggcgacgtgggcaagggcttccgctgcatccgcatggtgaacaacatccgcctcaacttcgacgccttccacggcgacaagggccacggcggcgtgcacgacggcaccaccgtggtgctgtgggagtgggccaagggcgacaaccagagctggaagatcctgccctggggcgacgaggcctacgccgcgggaggcagcagcgccgccaacgcgccccgcttcggcggcggcggcgagcccaccgtccgcatctactgcaaggccgacgaggggttcagcgccacggtccgcaacggcgccgtgtgcctcgcgcccaccaacccgcgcgacgagtaccagcactggatcaaggacatgcgccacagcaacagcgtcaaggacgaggaagggtacccggccttcgcgctcgtcaacagggtcaccggcgaggccatcaagcactcccagggcgagggccacccggtcaagctggtgccctacaaccccggctaccaggacgagtcggtgctgtggacggagagccgcgacgtcggccacggcttccgctgcgtccgcatggtcaacaacatctacctcaacttcgacgcct

SEQ ID NO: 17280 - DNA, 163 bp, Zea mays
  Clone ID: LIB3279-217-Q6-K1-D8
cccagcgtccgggcggcattcgtcaggcagttagaattatggcttagagaaacttagttgcttttccgatgggcgcttgtttcctagagagacaacccgcccaggaaaaaatactgtatgtccatcccggttgttcttgttcggctacaagatttgtgttttc

SEQ ID NO: 17281 - DNA, 627 bp, Zea mays
  Clone ID: LIB3279-217-Q6-K1-E10
cccagcgtccgtctagaacgcgagcggcccctttttttttttttttgcaactgaaaacacaaatcttgtagccgaacaagaacaaccgggatggacatacagtattttttcctgggcgggttgtctctctaggaaacaagcgcccatcggaaaagcaactaagtttctctaagccataattctaactgcctgacgaatgccgcccaattcttcagaaagctaggactgacacaaatgccacgaaaccaagagtgacagagaagccgtcagctatcatcttggacccccggctgtatcgcggcggcgtctgactgctcaccgatggtgacggtatcatacgtggtgtcgtcggcgttggcgtcgctggcgtggtgagggtcgctggagcactggagttggcgcttgcgtgtggagtgaccgccggtggcggcggcggcggtggcagcggcggtgatggtccatggggaagaagaccggcaactgcgcaggcgccggtggcgggcgggaggtcgaggcggcagagccgaggcatggccatcacgcgcgtcatgttgacggcgacgggggccgtgctggggttgctgagagcctggcagaggcactgcggctcgtcgtgcaccatgctgc

SEQ ID NO: 17282 - DNA, 614 bp, Zea mays
  Clone ID: LIB3279-217-Q6-K1-E11
tctagaacgcgagccgccgccctttttttttttttttttttttttttttttttttttttttttttttttttttttttttttttttttttttttttaaatcaaggagcccttaattccaagtttcggtttccataaaaggagggaaaaagaatgtccaacacgattacatataataagagggaaggggtccaagttaccattcataaaacacaaagcatgctatacatttaagaaaaatcaccatcagcaggcaaaaacaagggctgctcaacggtttttaaagggcttcaagcagggctgggataaaaacattgacccgaaaactaaacgttaacatggggcatgagcatctcagtaaagcaggaaggaccatttaacatcctttcctttgccctctgaggaaaaaaaccgatactgtcatcaggggatcacacggaagccaaaacctgagtccccgttgaagcttaacggcccaccatgtacctggtattaacatgtcagcctgaaaaatgttcggaaaagcaagtaacacgaggcaagcagccatccatgggcagttacataagcatttacttgatcctgccaaaaaaagctagctgctcgtatgcacccag

SEQ ID NO: 17283 - DNA, 592 bp, Zea mays
  Clone ID: LIB3279-217-Q6-K1-E7
gtcgccaacgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactagaagtatcctgatgcggtcatcgtcaggcttgtgtgctgctcttgtccccgttgtggtttgcaacacctgatgttgtaagactttctggttatgtccgccccgctttgccactgggttattaagaacgtcgttatggatggttgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgcccgttttaaaaaaatccaattttacttccccgtgcttgcaacgtaataatttttttttggggcccccaaaataaaattaatgggccggcttttaaaaacctcggaattggaaaacccttggctttcccaaatttaatcgctttggaaaaaatccccttt

SEQ ID NO: 17284 - DNA, 623 bp, Zea mays
  unsure (1)..(623): unsure at all n locations; Clone ID: LIB3279-217-Q6-K1-E8
acaaccgcagcaagagnagaggagaggaggctcaccggtcgcgaccaaattctcccagaccggtcggaaatgaggagccaagcgctgttcttcctcacgatcgcccttctcaccgtgctcgcgcgatccagcaacaggcaccaccaccaccaccactcccacgttcaaagcagagggcagggagcagcatcaggaggaggaggaggaggaggggagctggcgagccgggcgccggcgccggcgcgcgcgtggccgtgctgcgacagctgcggcggctgcaccaggtcggagccgcggctgtgccggtgcctggacgcggcgccccgcgggtgccacccggcctgcagggactgcgtcaagtccagcctcagcgccgacccgccggtgtaccagtgcatggaccgcgtccccgacttctgcctgcgccgctgcaccgcgcctgccgccgccgccgcgcggtgaccacgcggccgacgccgacccggcgactggtctctggttgctcttggnntcttgacccacccacccaccaccaaccgctccagcctttcgcccaccccaccgccggcgaatcgtgtcgtctgaactctgagccagctgtggattagggttttttttgttgc

SEQ ID NO: 17285 - DNA, 636 bp, Zea mays
  unsure (1)..(636): unsure at all n locations; Clone ID: LIB3279-217-Q6-K1-E9
ngacgatgacagactgcaaanacccatccacaatattgaaacttttattttcagaatgtcgtgataaatttattcattcacatgatatgaatccttttatggtgacttggtgcagggccacttcgatatactctctctttcgggctcattcttgcttgcagaggatggtgacactcgcagcagaacaggtggtttgagcgtggcactggctggaagtgatggacgcatagttggaggttgtgttgctggaatgctgatggcagcgacacctgtgcaggttgtagttggcagtttcattgctgaagctaaaaagccaaaagaagagcaacccaaacgtgagccaacatcggtgccaccgcacacagctgtctttggggcggcctcgactgccagccccccatcggatggcacatcaagtgagcactccgatgatcccgggagccccatgggaccaaacggcagtgcattcaccagcgcggggcttcccctgcactccacatatgctgcagttggttggtcactatcagaggaccaaagccgttatgatccagatctaaagatgatgaccgactgatgggtgccgtttcgcagcttccttgttagcagttgacttagctgagtaggctcanataacta

SEQ ID NO: 17286 - DNA, 633 bp, Zea mays
  Clone ID: LIB3279-217-Q6-K1-F10
gcgaccgcaccggcacggcgcccatccatccatcgccatcctctagcccagtccaaaggaaccctagccatgagcgccgcctccaagaagctcttccaggccgccaggtccctcgtcctctccgcttctaaccgctccgtcctcgccgccgagggccgcaccgccgcgctcgccacgctcaccaactttggcaggaagaccctccccaccgcctacttatcctaccacaagcagggatcccaccatgccgcgtcggggtggggagccatcgccgccgcagtcccagctgcagtttacatgctccaggaccaggaggctcatgctgcagagatggagcgcaccttcattgccatcaagcctgatggtgtccaaagaggcctgatttctgagattatgagccgatttgagagaaaaggctataagcttgttgccatcaagctgattgttccatccaaagaatttgctgagaagcactaccatgatctcaaggaaaggcctttcttcagtgggttgtgtgattttctcagctctggccctgtgcttgcaatggtttgggaaggagagggtgtcatcaagtatgggagaaaactaattggtgccacagacccacagaaatctgaaccaggaaccatc

SEQ ID NO: 17287 - DNA, 291 bp, Zea mays
  unsure (1)..(291): unsure at all n locations; Clone ID: LIB3279-217-Q6-K1-F11
ctgagcccganagcttcgcgacgctgngatggaccgttcctgaagacgccccgtcgggcgtttataggttgaggcattttggtgcctccaaaccactgattgggtccatcaaacattttacggggacctctcgggcgttcgcagtgcgttaggtaggtagcacaccgttgcgttgcgttcgacggcacacctgccagagaatcgacaccgggtcatatacttactttgcatacctgccacagtatatggacatgttttccctatagtttttacatgctcctgatattaatt

SEQ ID NO: 17288 - DNA, 617 bp, Zea mays
  unsure (1)..(617): unsure at all n locations; Clone ID: LIB3279-217-Q6-K1-F7
gcactctctctcaaggcgctgtcctcctccggccacccggcgacgacccgcctgctcttctcgcttctgctcgtgggctcggcggcgggcttgccggagcgggcggccatcgacagggtcaaccggcgaggcccttccctcggcctcgtcatgtcctacgtcgacgaggccaccgcgctgcaggcctccggctacttccagccttggcgtgccctccctttcgttgacctctacggacggcggtatcacatcggcagcattcggggcgtgaacgtgatatacgcactgacagggcaacgcaggctgaacgccgccgtcacagtacagacgctcatcgacgtcttcagcgtgtccggcattgttcactacggcacggcagggagctgcaacgactccatctccttcggcgacgtcagtgtccccaggctcgtcgcctacacgggtgcctggacatggaagaagttcagatcaccgagagagtcatcggcggaattgagcttcggcgaatacaacgtcccagacggaggaggaggggagaatctgctcggatccctcaagtacagaaacgaggagctttactcggccggcaagcccatgnaagaggtcttctggctgcc

SEQ ID NO: 17289 - DNA, 641 bp, Zea mays
  unsure (1)..(641): unsure at all n locations; Clone ID: LIB3279-217-Q6-K1-F8
gggccctggnagctgcttcttccttccaatggtgctaggatatataacaaactgatggacttcatgcgacaacagtacagagatagaggataccaagaggtgttgagcccaaatatttacaatatgcaactatgggaaacttctggacacgccgcaaactataaggagaacatgtttgtttttgagatcgagaaacaggaatttggacttaagccaatgaattgtccaggacactgtctaatgtttgctaatagggttcggtcgtacagagagttgcctcttcgcatggctgattttggagtgcttcatagaaatgagcttagtggtgctcttacaggtttgacacgtgttagaagattccagcaggatgatgctcatatcttctgcagagaagaccaaatcaaggatgaagttaaggctgttttggaattcatcaattatgtttatgagatatttggcttcaaatatgagttggagttgtctacgagaccagagaagtatctaggtgaagttgaaacttggaacaaagctgagcaacaattgacagaagctttaaatgagtttgggaagccatggaagattaatgaaggggatggtgctttctacggcccaaaaatgatattggtgtgtttgatgccctt

SEQ ID NO: 17290 - DNA, 629 bp, Zea mays
  unsure (1)..(629): unsure at all n locations; Clone ID: LIB3279-217-Q6-K1-F9
gggnaaacctgagcaacttaagcacagcagtgaaatgaacatcaatgccctggagaacaagctcagccacgcccttgtacagcaagcaagagatgaagctgcaatgaagcaactgaagttggagctgagtgcccataaatctcacatcgacatgttaggtagcaggttggagcaggttactaatgacgtgcattcgcagtataaaaatgagatccaggatttgagggatgtggtttctgttgaacaagaggagaaaaaggacattcacaggaagcttcagaatgtggaaaacgagttgaggatcacgaggatgaagcaggcggagcagcaaagggattctgtctcggtccagcacgtggagacgctgaagcagaaggtcatgaggctccggaaggagaacgagtccctgaagaggaggctggcgagctctgaagtctgaactggagtgcacatgaaaactgcaactgctttccttcacgccgtagttttatctcatactgtaggatgtagaaaaatccactgctccaaaaacacatatcacttccagatgctttaaaactagcaatgataggtatgttttcactgaaagttattatcaccaatcgacacactcataaccttttcatatg

SEQ ID NO: 17291 - DNA, 635 bp, Zea mays
  Clone ID: LIB3279-217-Q6-K1-G10
gccgaccgaccaaatcgcctcttcttctccaacctcccctcgcctcttgactaggccagggttccatcccaccccgccgccatccgatccgatggagggcggcgactcgtccggcgccggcggcggcgccggctccggtggcgccgtggcggcggcggccaagtggcggagcgacgcgtcgcggtcgttccagtactacctggaccgctccacgcctcacgccactgggcggtggctcggcacgctcgccgccgcggcaatctacgcgctgcgggtctacatggcgcagggcttctacatcgtcacctacgggcttgggatctacctcctcaacctcctcatcggtttcctctcccccatggtcgaccccgagctcgacccctccgccgccgccgaggggccggcgctgcccacccgggggtctgacgagttcaagcccttcatcaggcgtctccccgagttcaagttctggtatgcaatcacaaaagcttttgttgtagcttttgtgatgactttcttctctgtgtttgacgttcctgtcttctggcctatactcctctgctactgggttgttctctttgtccttacaatgaagcgccagattgtgcatatgatcaaatacaaatatgtgcctt

SEQ ID NO: 17292 - DNA, 536 bp, Zea mays
  Clone ID: LIB3279-217-Q6-K1-G11
gcattcttcgattacgattcccaatccagcaaaccctaccagccttttgcaaactcagagagggacccgatggcacccaagcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttc

SEQ ID NO: 17293 - DNA, 171 bp, Zea mays
  unsure (1)..(171): unsure at all n locations; Clone ID: LIB3279-217-Q6-K1-G7
nttggcactcctgctcattnattcaccaactgttggcatatcattgaatttgcttataaacgtgggngaaacataacttgcctgggaagtggtggctgtcagcctgcgatcgtgaactgtaacttatcgaaaatgcaacggagtttgggactctactatatgatttgtttc

SEQ ID NO: 17294 - DNA, 595 bp, Zea mays
  Clone ID: LIB3279-217-Q6-K1-G9
gttaagcaaaaagatactaactgaagctccgatgatttacatacagccttgaagaagggggcgagccttgaggatactcacgtgatttcattggaagcgctcagccccaactatcggttgttaatggctgatccaaggtcgagcttatcaccatcgacgttggtgaagactgagcgcttgcctacgtgatacataacagacccaaactcgtctgaacgggctaacggagacatgatgtcaatgattgcgaaaaaacatggcttgggtgccttatgtacattttgtagaccggcttatcgaggattgacagttggaaacacatacttcttgactatccattccacacaggacatgaatgcactgaatcatatgagcattcatagagataagatgtacaactactgcatgccttactataagacgctgcaacctctagaagacgatacagacactgatatcagtttcatataaactctaaaacccccgatagaaaattactacgactggaaacaggactattgctaggtttttgctgatcagaaagttcaagaaggtggcctgccatatgatgagaaagaaaaatcaacgagttcct

SEQ ID NO: 17295 - DNA, 634 bp, Zea mays
  Clone ID: LIB3279-217-Q6-K1-H10
gcgttcgcactttttccgttccacttccaggtccgagggctccagaaaccggcaagcaaggggatcgaagcggagagcaagggagcggtcgagcgggtgacatcatcgtcatccagggtttctcaatcggcagcgatggcgaccagggcggcggcgaggttcctgcagcgcaggtttctggcttgtggcggtaaggtcctcagcgaggaggagaaggccgccgagaacgtgtacatcaagaaagtggaacaagagaagctggagaagctcgcacgcaagggccccagctcaggagagcaaccctcgtcaaccacaggctctgcagcaagtgatgtgaaggccgatgctgggccaacggagtcagcatctgcaagtgtgtcgacggacaagaacaggaactatgctgttctggcaggcgcagttgctgccctgggtggcttgggttggtatctattgtcaaagcctaagaagtcggaggaggttgtggactgaagagggaggttgtgaatgcgatctgcggatggtcggccttatatctcaccatggttttactttctgcgcatagacctgcaacttctggaaataattgttgaaatttactctgcactactcgttcttaggcctgttgcatcac

SEQ ID NO: 17296 - DNA, 639 bp, Zea mays
  unsure (1)..(639): unsure at all n locations; Clone ID: LIB3279-217-Q6-K1-H8
gcgagtggctagcagttgtggcatttcttcttttcgtggcatcgtggatacttctccggcttgttatattccctttctggatcctaagaagcacaagctatgaagtactgctgaccctgngacaaggagaaacatcagttttatggccccatatactattatgttttcaactgtcttctgttctcactcctagttcttcacatatattggtgggtactgatatggcggatgctagttaagcagattcaatcgaaagggcatgttggtgatgatgttcgatccgattctgaaggcgaagaggaacatgaagattaactttttaggttgaatgcttaactgaagaactatgttgtgtgatacctacagcaaggcacaccttctgaaaccaccttttccttctaaagaagatttgcagatattagattttattagatcatatcattctttcagcatcaaagatgacaactatcatttgcgagttgccactgaagccgtctgtgctcttggatgtttgtatgaaaacagaagtgcattgtatttttttcccagtcaagcgtcatttgtaaaagatacagaataatcgcttgttcatccattcttgtaactagacagttgatttgatttcaaatcatgtaattt

SEQ ID NO: 17297 - DNA, 647 bp, Zea mays
  unsure (1)..(647): unsure at all n locations; Clone ID: LIB3279-217-Q6-K1-H9
ggaaaactccatcagnataccagattgtgccaggattcagggttcgcattataccagtattgggaaccatccctgcaatatttggtcaagttatggcctcctatgtggtcactcagcttgctggattagattttcaaactgaaccggttgttaacctggatttggatcattaccgtatacttcatcagcgtcttattgagcatgaggaactgatgtatggcacagccgagcaagttctggtagatgctgaagaggtaatgtacattgtcaaagaattgtggcgtggtcgaagtgctagagaccaaagccaggacactggccggaagatgtggagatctgtgaacgaactaatgcttgttcggtgggacaaatcaaaggctgctggcatctcaaacttaatacttgtcaagttcagtgaggctgacgcccatgaatccaccacactcgaccgaataaaagaacaagaacctgaattctactctatggtttcacgtgtcctgaaacgagctgagatggagtttgccttatgacttgatgagtagcgagggttgatcctgttggactcccacgccttggaacagcattcagtttggcgggaatcacactggggtacctgattggtgtgctatggtgaaaatgtgatgtgc

SEQ ID NO: 17298 - DNA, 595 bp, Zea mays
  unsure (1)..(595): unsure at all n locations; Clone ID: LIB3279-218-Q6-K1-A10
ccccgcgtccgcggccgcgtgggcggncgcgtgggcgcggctactccttcaccaccactgctgagcgggaaattgtcagggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtntccacgagaccacctacaactccatcatgaagtgcgacgtggatattaggaaggatctgtntggcaacatcgtcctctccggtggtaccactatgttccctggcattgctgacaggatgagcaaggaaatcaccgccctggctcctagcngcntgaagatcaaggtggttgctcctcncgaaaggaagtccagtgtctggattgggggatccatcctggcatcgctcagcaccttcccagcggtgtgggttgccagggctgggtgcgacgtgtttggcccgtccctcgtgccctgggaaatggcttgtattgtttgggcccgggg

SEQ ID NO: 17299 - DNA, 637 bp, Zea mays
  Clone ID: LIB3279-218-Q6-K1-A11
ccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtcgaggggaagcatggcggcaagctccccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccctcc

SEQ ID NO: 17300 - DNA, 180 bp, Zea mays
  unsure (1)..(180): unsure at all n locations; Clone ID: LIB3279-218-Q6-K1-A7
agcgtccgcccagcgtccgtgttatggtgatcctgnatttatcggcagaattggacggnacattgagnatacaagtgctcatggctagttgtgcaagcccttgagcgtgctgatgagagccaaaagcgcattctatttgtaagtcggctgcagacctctttgaaacgattaagaatttgt

SEQ ID NO: 17301 - DNA, 637 bp, Zea mays
  unsure (1)..(637): unsure at all n locations; Clone ID: LIB3279-218-Q6-K1-A8
caaccatctaccagcgactcagcgagcgagnacagcacacactgcacgcagctagctaggagcagcagcagcggcggcgatggcggcctccatgatctcctcgtcagctctggcggtggcgcctcagggcctgccgcccctcggccgccgcgcctcctccttcgccgtcgtctgctccaagaagaagatcaagaccgacaagccctacgggattgggggtggcctgaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctgggccgtcaccctcgctgggatcctcggcggcggcgccctcctcgtctacaacaccagcgccctctccggctaaggatatccaatgcatgcgcttcttgcgattcgtcatgtaaaatcagggtgtctgtctataatctagcctccatggatgctcaaccttcgtcatgtaacaataatcagtgctactcttcattacataattttgatgctatatatataaaaaaaaaaaaaaaggcggccgctc

SEQ ID NO: 17302 - DNA, 637 bp, Zea mays
  Clone ID: LIB3279-218-Q6-K1-A9
ctagttctagatcgcgagcgtccgccctttttttttttttttttttttttagatttaatgtcttaaaaatatttatttgggaacagcagagtacgtagcgtagatagtacattagtacatcaagacacctactagtagctatttaaacgatggccattatcataattcccatgccaaagccgattattttttaacccaaacaaacttactggcttgacttagctgataacaaatcagcaatgcaagccgcacggacgaccagatagttgagcgtgagcatgcatgactttattcggagctgttcaccacccggcagttccggcggacctcgccgctggtgccgacgcccggtgcaagcctccccatccgcagcatggactccgcgaagtcctggaagaatacggaggcgtcgaaggcgtaggtggcgacgaggctggcgacgtccgcctctaccccaggcacggcagccgacgacgccagtgcctggtctgacggcagcagaccgtcgccagagagcaggttgatgtagtactggttgtcgaaggtcgccggggtggcgaggtccaggtgtgccagcgcggacccagccgaccccgtgcacagctgctgcagcgactgcaagaaggtgaggtccttg

SEQ ID NO: 17303 - DNA, 590 bp, Zea mays
  unsure (1)..(590): unsure at all n locations; Clone ID: LIB3279-218-Q6-K1-B10
ttgaggtcaatactagnatacccaaacccctagagctgatttaataaccaaggaattgaaggggaacataggggaggaatccactcgctaattaaaattgaatagcgaggggattcttctccatggatctcctccaattcactggtaaccaaatcagaccttatagaacagagatgtaatttcatgtctgattatagcgggagtgtaacttccttgacattatatcattggtaaaagaatctgatgtagagtnaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaanannnnnaanaaaaaaaaaaaaaaaaaaaaaaaaaaaaaagggggggcccttttggggttttnngttttggtgcccggtgtttgcggctttttgttttttttttggggcccccttattttatttagggggccgggttttacaccgggggggtgggaaaaaccctggggttccccccttttatttggttgggggcattcccccttttcccggcttggggtttttggtgaggggccccccc

SEQ ID NO: 17304 - DNA, 638 bp, Zea mays
  Clone ID: LIB3279-218-Q6-K1-B11
cagcagcgcctccttgctctctctcacgagtcccggcgttccagtggggggcattcatggcggggcagtccgacccgcacctctccatcttctcgccctccgaggtggagttcgtggctgaggatgagattgtcgaaatcgtccccaacatccgcatggacgccctcaacatgatctgcggggatttcgggcccttcttcccccagattcccaccaaggtgcctctctggctcgctgtcgcgctcaagaagcgtagcaagtgcaccatccgcaccccggactggatgactgttgaccgcttgacacaggtattggaagcggaaagagagtcgccacgagaattccagccattaccattccactatattgaaatttctaagcttctgtttgatcatgctcgtgatgacatctcagatgcatacctggtaagatctctaattgaggacatcagagatgtcagatttcacaaggttgagactggattagagacgatatctggacgcacccatgccgtaaagctcaaaaatctctctgcaatggaagtgaacattgtccgccctttcatggtgagaactttgcaggcattctataagcacgatagtgcacagatgattcagcaagcagataatatagggagc

SEQ ID NO: 17305 - DNA, 630 bp, Zea mays
  Clone ID: LIB3279-218-Q6-K1-B8
aaacaccattcttcacttcccctcggtacttgccaccaacgaagtcggataagtgcaggattaaagacgcgatcatttcacacggctgcttcttgcgtgagtgtgccatcgaccactctattgttggtgttcgctcacgcctaaactctggatgcgagctcaagaataccatgatgatgggtgcggatttgtatgagaccgaagacgagatctcaaggctactggcagagggcaaggtgcccattggcgtaggggagaacacgaagataagcaactgcatcatcgacatgaatgccagggttggaaggaacgtctccataacaaacaaagagggcgtccaagaagccgaccggccggacgaaggatactacatccggtctgggatcgtggtagtcctgaagaacgcaaccatcaaggacggcaccgtcatatagagactaactttggccttacgcatggcgtgcaaggttacaggttagtcatcgtcttgagagttgagacttagtttgaggcgcgcgcccgaccttgacttgaatcgttggagggacaagaacatgaggaagaagaaggctggtggtgccggatgttgccatggacgacgagaaatggtttggtgcggtcgcatcggtt

SEQ ID NO: 17306 - DNA, 206 bp, Zea mays
  Clone ID: LIB3279-218-Q6-K1-B9
catccgtgttcttgtttgcgaggtcgagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaagggcacgccgagggcgggttcga

SEQ ID NO: 17307 - DNA, 617 bp, Zea mays
  Clone ID: LIB3279-218-Q6-K1-C10
gtcgttcgctttgccttgccccggcaaagcaatggcgctccgtctctctgctccgttcctcacctcgcgctttacgccgtcgcaagcgttggccccgcgcaggcgcacccgggcccgctctttctctccgtcagccgatgcgcgagccgcgtgcttcaagagaccctacacgtccgttctaattatccccacgggcgtcggcgcggccgtcgggggcttcgccggcgacgcccttccggttgcgcgagccatcgccggcgtcgctgactgtgtcatatcccacccaaacgtgctgaacgctgcgatgctatactggccgatgcccaatacactttacgtggaagggtacgcccttgacaggttcgcagaaggatcctgggctctccaacctgttcaccagaacaaggtttggtgctggattctggaatcgaggaagacctccggctgcgccacttgcagattgcagatgccactagggcttctcttggcttgcctgtagtggagtacattgttacagatgctcctctggagatcaagacatggtttgatcccaggtgtgggaagtcaacagggagtgttggtaactctgattctcttctgagagcagttgacgcact

SEQ ID NO: 17308 - DNA, 86 bp, Zea mays
  Clone ID: LIB3279-218-Q6-K1-C11
gtcacccttttatctatcctgtttttgtaccgtttcttaggcactcttggctggcagatcattgtgagtctgttgaacttgagaat

SEQ ID NO: 17309 - DNA, 399 bp, Zea mays
  Clone ID: LIB3279-218-Q6-K1-C7
gtattaggtccccggcccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcctatgctgttggagcagacttttgtctcttgatcataaatatttaaacgaacctgttatgttggaat

SEQ ID NO: 17310 - DNA, 456 bp, Zea mays
  Clone ID: LIB3279-218-Q6-K1-C8
gtctaaccggtcagactagttagggtttcctgtgagcctgctcccctgccgcgccgccatgggacactccacgtgtggaactcgcaccccaagaactacggccctggatctagggtttgccgtgtgtgcgctaacccccacggcttgatccgaaagtcgggctcatgtgctgcagacagtgcttccgcagcaacgccaaggacattggcttcatcaagtaccgctgaaacttggggagctccaaagcatggcaataatggaagcatggatggggacctaaaagatagcctgtactcttattcttatgataaaaccatgtaatgaattgtttggctttgtgtggacgaagttggtgtattctagatggtactcttgaatcttgatgcttccctgctatgctagctgagcatgtcgaaccgctatgaatcagacaatacagtatcaatgttaccactc

SEQ ID NO: 17311 - DNA, 449 bp, Zea mays
  Clone ID: LIB3279-218-Q6-K1-C9
gtttttccgttctcgttctccttttccccggtggtcccttggctatatctggcgtacgcatggcgtgaacgcatgcagccggccggcgggcgggcgggcgggcggctcacgagtgaaggtaaccatgtcgatgtcctcgcccacggtccaggtttcgtcttcatcgtcctccatcatcgccaccaccgctgtcggctcgcacgtgctcaagatcgacggctactcgcgcaccaagggcctcgccaccggcatccacctcaagtcctgctcgttccgcgtcggcggccactcctggcacctcgcttacctccccaacggcgactgcgcgcagacggccgactacatctcgctctacctcgttctcgaggacgcacccgccaaccgcacccccgcgctcgcgcagctcagcgtcggccttctcgaccgtgccggcaaagccgtgccgtccc

SEQ ID NO: 17312 - DNA, 350 bp, Zea mays
  unsure (1)..(350): unsure at all n locations; Clone ID: LIB3279-218-Q6-K1-D10
gtcagnaactctttatcgattggagccatgcagtacagtgtactgtgtacacagagactgtagaatcacccaggccccatttggaatgtggggatccattacaatttccactttggatagtactgtnnttctgtgaaataacntgaaaagttcatgggaagttcgtgttaatcttttttttttatatcttggtggggcagaacagaagcagtcaaatatttttttgtgcatatgtgaaattccagagttgtgggtggtgagagataggatacaatgctgtatgtatttcaggaacttctgtaacacgagaacattcatcatgtgaaaaaatgtaactgaatgtgttggcc

SEQ ID NO: 17313 - DNA, 641 bp, Zea mays
  Clone ID: LIB3279-218-Q6-K1-D11
ctgaacaaaaccaagcatctgttatatatgttccaccaccatttgctgccgccgctataatggaggcaatggaggctgagctcgaccttgttgtctgcattacggaaggaattccccagcatgacatggtgaaagtgaaggctgcactaaatagacaatctaaaactcgattgattgggccaaattgccctggtatcattaagcctggtgagtgtaaaattggaatcatgccaggttacatccacaagcctgggcgtattgggattgtatctcgttctggtaccttgacatatgaagcggtgtttcaaacaacagctgtaggcttggggcagtcaacttgtgtaggcattggtggtgacccattcaatggcacaaattttgttgattgccttgaaaaatttgtcgatgaccctcagacagaaggcattgttctcatcggtgaaattggaggtacggctgaggaggatgctgcaacgttcatccaggaaagcaaaacacaaaagcctgttgttgcattcattgctggacttacggcacccccaggccgtcgcatgggtcatgctggagctatcgtggcaggaggaaagggtactgcccaggacaaaatcaaggcactcagagaggctggtgttaccgttgtc

SEQ ID NO: 17314 - DNA, 153 bp, Zea mays
  unsure (1)..(153): unsure at all n locations; Clone ID: LIB3279-218-Q6-K1-D7
ggcgccgccggccgaggccgagtgcgagcagacctacggcttcctcccctgcaccaccaccgtgctcggcaacctcttcctggtgctggcctacggcttcctcatgttcaaggcggccacgttcctgtcggcgggcagcgagctgnnctgcta

SEQ ID NO: 17315 - DNA, 590 bp, Zea mays
  Clone ID: LIB3279-218-Q6-K1-D8
gctcgattgaacaaattggagcagcactacactcctccacgcctccacctccagcctcccactgatctggcctctctcgagttaatcctagatcaatatgagaaggggctacagttacagtccttcaccaccaaggggctacaggagaagggcccgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggatccccgagggtttgggtttgtccagtattatgatcctgctgatgctgctgatgcgaagtactatatggatgggcaggtagttcttggtaggcaaataacagttgtttttgcagaagagaacagaaagaagcctcaagagatgagagctagggacagagtcaggggtcattcttatgatgacaggaggtattctcgctctaggtcccctcgttattataggggccgctctccttcacgcagccaaagctactcaaggtctccacctc

SEQ ID NO: 17316 - DNA, 630 bp, Zea mays
  unsure (1)..(630): unsure at all n locations; Clone ID: LIB3279-218-Q6-K1-D9
ctccttcctcgcttcctttcttacctcttctccacgaaatctgccattgctgctcgtttctcttctgcagcctcgctacttcgctagacatcgctaacaggaggacgtgggcacgtggcagtggtgctggtgcacctctataccatcctcagcggcgtgcatatggcctgctgcgggggaacgcggcgtcgcgcggcggggatacaccgccatcaccttcgacatacgcggcgctccacggggcgtgcgtcggtcacgggctccaccgaggccggacgtcgtcgccgtctaccgatgtgtcgcagagaacatcaggccgcgtgacatcctcctcgtcggatcctcatccggggcaccaattgctggacctgcagttgatatacagtgtgtttggttagaggcatccaatggtccagagtcatccgaacctaaaacagcgtttggttaccgtcacggattcatctcatccatcatccactcattccgatctaaaactaaaatctagaagctgcccattcctcgtaaaacagacggaccaactcattcctcccatccgaacctgcaaggagtgagtccatactggatcaccntgttccgaacaggttattccactaaccaaactactaatag

SEQ ID NO: 17317 - DNA, 617 bp, Zea mays
  unsure (1)..(617): unsure at all n locations; Clone ID: LIB3279-218-Q6-K1-E10
ccccgcgtccggnaacaccccccatacatggccgcgctcagttcttgtgttgcttctggaggcctggcacttcaggccacccttgtggtttctcctcctcgccgccgcgggactccagtcgtcatctccgtatcatctcatggtcgccgcccaagtcttatcggctccaccatgaatccttcaggcatggctccgatcaaaagaactacacgaattcgtgcggttcatccatgccctgcaaattcgttaggaggaagcctcaccatcatcccaatacctgacctgctttcatcatggctctggatgttcggagcggccatagctgcagcagtgcctctttacagaaggttcagagcattagaagataacgtagagaagacggcggaggcggcgatcgaggtgatcgactcggtggcggaggcgaccgagaaggtcgccgacgaggttgcgcaagcgttccccggcagtgaaactctcaagcaggcagcctccaagattaagacgatcgcggatgagatcgaggaagatgccgacaaagctgaggccctgattgagaaggttgacgagataaagaaagagtggattcaatcgtcgaccctatactcgacaaggtcgcc

SEQ ID NO: 17318 - DNA, 600 bp, Zea mays
  Clone ID: LIB3279-218-Q6-K1-E11
cgaaacatggattttccctacaataatgcaaccggttgcactggcaactattcctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggccccccctttttaaaaaaccaaatttaactccccgggcctgccaacaaaaaactttttttttggggccccaaaaataaaataaatggcccgggtttaaaaaacgggggaagggaaaaaacccgggggtccccaaattaaatcctttggaaaaaaacccccttttcccccgttgggtaaaaacaaaaaagccccaaccaaatcccctttccaaaaatttcccaaccctaaagggaaaagggaaccccccttttaccggccaataaaccccgggggggggggggtttcccccaaggggaccctttaattttgcaagcccctaacccccctttctttggtttttttcccttttttttttccaacttttcccggttttcccccgaaaagtttaaaaagggggc

SEQ ID NO: 17319 - DNA, 588 bp, Zea mays
  unsure (1)..(588): unsure at all n locations; Clone ID: LIB3279-218-Q6-K1-E7
cccccgactgcagccgccagccgcgccatgnagcaagcagccatgccgcaggttccccgcgtcaagctcggcatccaggggcttgaggtgtcgaagctggggttcgggtgcatggggctcacgggcacctacaacgcgccgctcggcgacgaggccgtggccgccgtcgtcgcgcacgccttccgccgcgggatcaccttcttcgacacctccgatgcctacgggccccgcaccaacgagaccctcctggggaaggcgctcaagcagctgccgagggagcaggtgcaggtggccaccaagttcgggataggtcagggcgccgctggcatgaccgtgtgcggcacgcccgagtacgtacgcgcctgctgcgaggccagcctgcgccgcctcgacgccggctacatcgacctctactaccagcaccgcgtcgacaccaccgtccccatcgaggatacgattggtgagctcaagaagttggtggaggaggggaaggtcaagtacatcggcttgtcagaggccagcccagacacaatccgccgtgcgcacgccgtgcatcccatcaccgccgtgcagatggagtggtcgctc

SEQ ID NO: 17320 - DNA, 623 bp, Zea mays
  unsure (1)..(623): unsure at all n locations; Clone ID: LIB3279-218-Q6-K1-E8
gnttaatcttgntgttaatgtacactttgtatgtttctcctgtgttgatggtgaactttacgagcttgatggtctaaaatcacaacccacaccccatggcccttcatcacctgaaaccttgttgcaggatgctgcagaagtcatcaaagctagaattgcggagaaccctaactcgatgaacttcaatgtcatggccctttcaaagaagtgaagtatactgtgatgggtggatttcatttggcagaatacgggtcccttttcttttcagttctgctgagtactgcaccgagtggaaggtttgcacagggaaacaaagatagggaaaaaatgttgactcgatgattctcgtgccttcttgatggatagagaaatggtggttcacgatttcacctttttcctgcgtacttaggctatttacaagggtagttttatgatggtttcatacacatttaatagtatgtcacatcaccatttgtttcatctttacatattttattgttttctattgactatttagttgcagtatttaattggtatgttagtttatgaaatagtgaagtgaaattttgtattgagaaacattgtttcattcttaattttatgacactctntgatgatatggc

SEQ ID NO: 17321 - DNA, 662 bp, Zea mays
  unsure (1)..(662): unsure at all n locations; Clone ID: LIB3279-218-Q6-K1-E9
ggnaaagcaccggcctaccaaaatgaacttccacagttggaaccagatgagagaagcgtgacaaacataaaagaagtgttcgggactttgttgtcggcagtggtgaatatgtgatcaaagattttaagttcactgttaaccaagcagtgcgaccagtggagaagcgcattgataaattgatgaaaaagaatgataagagtaagaaaagccaggacgacaactgggtgagtgcagcaacaccagagaggcctgttcgtgggattgatgatccattattaagcggaagcgcaagtgacagtggtgtcacaaagggcagaaaatatcgcagagttgtgagctcagttactgctgtggacagctggggaggtggtgatcaagcttctgacggatatgagatcaggggtcgccgctgggctgtaaaaagctaacgatttacatagcgagatggtaaattcgaaccatatcgcgtggggggaaaaggacttttaggtttgcaactgtttctgcgatactggccatttaggagccttctcaagttcagattgtctttgtataggtacttaggtagctgataatgatatgtaacctttttgcgtagattgnttaattttcttttctttttcttggtcgagtcgtactgacattntgtattgcaaaatttg

SEQ ID NO: 17322 - DNA, 627 bp, Zea mays
  Clone ID: LIB3279-218-Q6-K1-F11
cccagcgtccgccccgcgtcccgagaccagctagctagctcctcccactgctatcacccgggccccggccagccatctcgctgaaagagaaaagcgcagccatgaagactactagctcgggcattgcagtcgtcctcctggtggcgatgctggcagtccagtccgcggtggccgacatctcgtgctccgacgtgctcaacgacctgtcgccgtgcctgcccttcctgcagggcaaggcagccaaacccagcgagagcaacaaccagtgctgcgacggcgtgaggaccctgtacgcggcggcggacaccaggcccgacaggcaggccacgtgccggtgcctcaaggcggcctacgttcaggtccacgctgtgctctccgcggcgcaggagctgcccggcgactgcggcctctcgctgtcctacaacatcacccccgacatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttctt

SEQ ID NO: 17323 - DNA, 527 bp, Zea mays
  Clone ID: LIB3279-218-Q6-K1-F7
ccccgcgtccggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctaccgcggtggcggcggctacggtggtggcggcggcggctaccgtggtggtggcggcggctaccgcggtggcaaccgtggc

SEQ ID NO: 17324 - DNA, 626 bp, Zea mays
  unsure (1)..(626): unsure at all n locations; Clone ID: LIB3279-218-Q6-K1-F8
atcaatcaaatanacaagnagccacctctaccaccgccatccgcagtccatacagtgacccccacgaggtcaagaacctgtacgaggagaggaaagaacctggaagagaggagcttgaggagttgaggagatggcgagcgccgagggcgagaggtgggtgggactggcgacggacttctcgcaggggagccgagcggcgctgcagtgggcggcgaccaacctgctccgcgccggtgaccacctgctgctgctgcacgtcatcaaggagcccgactacgagcagagcgaggccatcctctgggaatccaccggctcccaaatatggagcaaaacccgacatggaaaccttggacctcctgaacactacagctacccagaaggaagtgagcacaccaagcctctgattatggtggttgtgaaagtcctgtggggagatccgcgtgagaagctctgtcaagttatccatgacaccccgttgagctgcttggttataggaagcaggggccttggcaaactcaagaggtgctcttaggaagtgtcagcgattacgtcgtgaacaacgcaacctgccctgtcaccgttgtcaagtcattcaagcaccgaagggttgatctcatcaccgaatg

SEQ ID NO: 17325 - DNA, 620 bp, Zea mays
  unsure (1)..(620): unsure at all n locations; Clone ID: LIB3279-218-Q6-K1-F9
ctagnacgcgggcggccgctcgcgatctagacccacgccgtccgggnaagacagataagttgatggcagctgcataaggtgttacagagctccttgttttaacagctcctctctttccctcatcaacatgggtcattcttagtcataaatatatgttgagcatctcgaataacaatgtcaacacacatccccagcctatgcctttttggaaatcttttgctgctttcctaaattgaagatgcttaatttccatagtttgctgaggaaagtagctactgaggtgtaaattttggagtcaatatgtcgcttcttctgaagtcacagaatcatgctggcaggactggaatctaatctcaaccttgtgatctgtacaattgattcatttaaaggtgtatgcgggagtatgtttgatgcaagaactatgagccatccatcaggcatgagcaggaccaccacggtcctcaccgtgtcctcctacagcggctcctacagcggcgtggcggcggcaaacaccgtggatgacttgtgcgacatgatccgtggcttcgtggacgtgtgcgtcgcggctactgtccgtgcctagcgcggcccgtctgtcggccagcacggtcacctcctaa

SEQ ID NO: 17326 - DNA, 619 bp, Zea mays
  unsure (1)..(619): unsure at all n locations; Clone ID: LIB3279-218-Q6-K1-G10
gnaatccaaagccaaaaccccaatcgcacaggagagaccgagagagaggttttccatccatggctcccggcgtcgcttccgtgctggtcccgcaggagcccgtcctcctcaagacatcctcgcctcaccgtccccctgcgggaacaccgctgtctccgcccgccacctcttcggcaacggagtcgcgccgccacgctcctcggacgacggcatcaaggacgccgctgccgaccgccacggtgaccgcgacctctccatccccaagatcttcaccggagacgtgctggacctgctcgacgatgctgcgaggctggacctgatgctggcgctgacgggggacggcggtgcggcgtccatggccggcttctccgcgcgcgggtggtgggtctcgaaggaggatggcgacgcggtgcagctgaaggtgccgatgccggggctggggaaggagcacgtgaagatgcgggtggagaaggacgccctggtgatcaagggggaggccggcaaggacctcgagggcgacgacgacaagggcccggcgcggtacagctaccgcatcggcctctcctcccaggctttcaagatggaccagatcaaggctgacatgaagaacggcgtgctc

SEQ ID NO: 17327 - DNA, 232 bp, Zea mays
  Clone ID: LIB3279-218-Q6-K1-G11
caaaacctactcaacagcaaagacgcaggaaaagccgtccatacatggctccatgcgtggcttccgggctggttcccgaggaggccccgctagagaaggacatcctcaaggaaatgctcccctgaggcgaacacctgtgggtacacccgtgacttcttccgcaacctattcgggccggaggctcctcggcacactgcttgaacgacggcgttgacgaccgccatggcgaccg

SEQ ID NO: 17328 - DNA, 581 bp, Zea mays
  unsure (1)..(581): unsure at all n locations; Clone ID: LIB3279-218-Q6-K1-G12
gttttgctgctctccgtcctttggctgggggggcgcngcntcaggcgaggcccccctcgcgtgtgaccgngatggcgctgccgnntcaggggaccgttgnttaccccagcttcaagctcgtcatcgtcggcgntggtggttccttggtcaactacctttgtgaataggcttgggggggtgggggagtttgnngangaaatttgaaccacccttggtgtggaagttcatccgttggatttcaccactnactgtggtnagatcaggttctactgctgggataccgcagggcangaagagtttggtggcctccgggatggttcctatatccatggcccgtgtgcgatcatcatgtttgatgtncccctcaggcttacttacaagagtgttccttcgtggcgtcgggatctgtgcagggtctggggtgtcatccccattgtcctctgcggttctccggttgatgtgcagaaccggccggtccccgcccngcgtgttactttcccccgggcgaagcatctgccaggctgtgacctttctgccctgagctcctccggctttggggaaacctttcctgtgccttgcca

SEQ ID NO: 17329 - DNA, 374 bp, Zea mays
  unsure (1)..(374): unsure at all n locations; Clone ID: LIB3279-218-Q6-K1-G7
cggncgcgtgggttgcagtggtacagtgggggcggattgaggctgtagagccagccagtttcacggtgaaggaagacaacaacctgtctctaatagagtatgaattggttaatgtggctgagtaactgtccaatccaagcgtttctgccccctttatttcgtgccataagaaggaagtgccatgaatgaacattataaagcctcttgaagcgaagcgagtttatttgctacggtggggtagataaaggtcaaggctgtatggcctgtgttagaactttggataaattaagatgaattgcccttgcatctatgagattgttatccatctttgtactgctcgtgttgctttgatgcaagaaatctgnagcnggana

SEQ ID NO: 17330 - DNA, 656 bp, Zea mays
  unsure (1)..(656): unsure at all n locations; Clone ID: LIB3279-218-Q6-K1-G9
gtgtgcgaggactatttactgcacaaacattgacaagaaggtcactcaggcagatctgaaattgttctttgagtctatatgtggagaggtctttcggctgaggttgcttggtgactaccatcattctactcgcatcgcttttgtggaatttgtgatggcagaaagtgctaccgctgccctgaactgcagtggcgtgatactgggatccttgccaataagggtgagcccctcgaagactcccgtgcgtccccgtgcgcctcgccagctgatgcactagaggtgtcctaggtacaggaggtgcggaaggcactgcttatatatcatcatcatatatatataatagagaatagacatatatgaaagaggggaggggaaaagtggcgtcacttgttctaagttatgggctcggcctttttgttttgggttcttgcttcaccaccgtgtgactgagtactaaagtgcctacgtacgccccgggtcgacgccggctggcagggcccttttgtttactaccttgcacatagaaggagaggagatggagagcttctcactagaaggatcggaagcgcgcgcggnggggtctgcctgatgctcttgtccttgatgcaacaacnaggcggaaaactcctggacttttaccctgctgttcagttgtt

SEQ ID NO: 17331 - DNA, 533 bp, Zea mays
  Clone ID: LIB3279-218-Q6-K1-H10
gttgctccgcgccgctctcctgtcagtagccgctgccgccgacgctgcaagtgtgggtctgtcgccgtggccatgttcgcctggatcctccgcggctgccgcgacgagtgctccgcctccgaccagctcaagcaggctcacgatgtcttcaaggcgaaagaggtggtcctgcaaagagagagatctctcaagaggtggaacgggccaaggagttcacaaagtcgggaaacaagcaggcagcaatgcagtgcctgaagaggaagaggtactacgagagtcaaatgaaccaagttggaagcgttcagctgcgcattaacaccaaggagagaatgatcgctgatcacacgggcaacaaataacacaaagtgagaccgcatctctggaaccgtgtatcgaacacagctttgttctgttcagatatgaaatcttgtgagaatgagatgtcaaccattggtgtgttcttcgccaaacagcatatcacacttaacattagtgtgcctttaacataagcataagatattacattttggacc

SEQ ID NO: 17332 - DNA, 617 bp, Zea mays
  Clone ID: LIB3279-218-Q6-K1-H11
gtggcgtcgagtgggcgaccgccgccacccccgtgccgtgcgcgctctctctctctcgtgtcgacgggtgggtgggcgaccgtaggccgccgccgccgcctaggccaggtgcccaggtcgaccttcaacagcgacgagcatccaccagatttctacatgagtgtgatcttcctattgtgaattcagacgcaatcaagtatggcttcaatggcaatcattaggagaaggaagtatttcttggatcatgttaacacacctaccatttcatcgtctgctttctttacattccaacatggaagactcggtttggaggttgagccaagaacagaacagcgatttctcgagcatagttctggggattccaaatgcgagaaggagcaacacaatatgaatttgataaaaaaggatctactaggtcttggtaatgggttttggcaacgtccatcttatgtgatttctctttctcatggtggatttggaaggaatgaatttagattgcctctgagcctgggagctagatctttgctgcagtcggtccgcacagcatcaactgcaacagcaaggcagcctaagatggatacagatgatgaacagagcgaggaccacaagcaaaataa

SEQ ID NO: 17333 - DNA, 430 bp, Zea mays
  unsure (1)..(430): unsure at all n locations; Clone ID: LIB3279-218-Q6-K1-H12
ccggggncgccccccccggcccgccccgcgnnccgcccccgcggccggggggggcgcgggggcgccccccccngccggccgccgccccggcccgcccgccccccgccccccgcgcgcccccccccgcgcgcggccccccccgcccccgnccggcgccccccccccccgccgcccgccccnggggcccccccccccgccggggggggggggggccccncnccnccccnccccccccgcccccccccccgcccccccccccccccccgcccccccgcgcccccccgccccggccgcccccccggccgcccccccnccccccgggccccccccccccccgcccgcccccccccccgccccccgccccccccggccgcgcccccccccccccccccccccccccccccccccgccccgcccccccccccccccc

SEQ ID NO: 17334 - DNA, 627 bp, Zea mays
  Clone ID: LIB3279-218-Q6-K1-H7
tttctcggtacgcgcgcccaatcctccgcctccctcatcttggcgatcccaccattgcccgggcacatatctactttccttatttggcaccgggttttttccgagaatcagtggggtattcgctacttcactcctctttggatctggacggggcgcagatctgaccacgtctcggcgatggcttgcagtatcgccgtcaccgacaccgctagtgcattttttctccttttttctagcctaatgatgcaatgctgcccttgaacctattgtgcgtggctgtggttgaagtttttattgatgggtttccttggtagcaacaaacgcgcggcaaggctggcgggcaatccaactttggcggtggcgcgttttatatgcctaacccccaaaacgtgcctccgacatccaattcacgcctttcgccgctccctcctgaaccggcagacttcagtgctacagtggatataccccttgactcgtcaaaggacctgaagaaaagagagaaggagctgcaagcaagggaagcggaattaaacaagagggagaaggaactaaaacggagagaggaggctgcagcaagagctggcattgtcattgaggagaaaaattggcctccttttatgccactca

SEQ ID NO: 17335 - DNA, 636 bp, Zea mays
  Clone ID: LIB3279-218-Q6-K1-H8
cataaaccaaaaaagagccacatagtgtaccgggttcaacaaatggaacatcaattccagaccaaactttctgaaaatggaagttctgtggaggctcaggacaaagacgttattctggaaggccttagtactgttagttctcatgatcagtggactccattatctgtcagtggtcttcgtccgaagcctcgttatgagcatggagcaactgtgctgcaaaataagatgtatatatttggtggaaaccataatggacgttaccttagtgaccttcaggctttggatctgaagagtttgacctggtccaaggttgatgccaaattgcaagcagaacctgctgattccactaaaacaacacaaattgctccatgtgctggtcattctttgatttcatggggcaacaaatttttatctattgctgggcatacaaaagatccatctgaaggcgttacagtgaaggaatttgatccacatacttgtacttggtcgattgtcaggacttatgggaaaccaccggtttctcgtggaggtcaaacagtgactcttgttggaacgacgctagttttgtttggtggtgaagatgcagaacggtgtctcttgaatgacttgcacatccttgatcttgaaaccatgaca

SEQ ID NO: 17336 - DNA, 653 bp, Zea mays
  Clone ID: LIB3279-218-Q6-K1-H9
cagttctcccgactcccgcatgcttcaggagacacggtttacgccgcgatccgggatcgctctctctttgggctaccggctccgccgccctaagccaggtgctgaaggccttcgtcggtcttttcaccggcgacgacgacccaccaggaaagaattttcctggcacatttttgtttccagaaatatttgtgtcaagttggtatgtcagggatcacagcaatttggcgtcggtcatgtccattagctgctagtcagattctaatggagacatattttggcccatctgtatcttctggtgttctgaggtggttcagcagtggcgctaagcactcaagaaaacctgacttatctgttgctaaccatatcagggtggtggatttgcattcttcagttaattatgtgtcaacgatcagaaggttgcccctttcatgccgtatggacactaattggttgattacttcaaagtccagacatggtgcattgccaggattcttaggtgtttcaagcttctatcgtggatactcctcagatactggaatcaagccagaagcttcacagagtggtgtctctaatcttccttctacagaaagctctgaggttggcactgcaggtgctggtgggggttcatggattgaaatcttggacatgctcgc

SEQ ID NO: 17337 - DNA, 349 bp, Zea mays
  unsure (1)..(349): unsure at all n locations; Clone ID: LIB3279-008-P1-K1-F2.F2
gtgtggagggggggaatttgggtatttttttttttgtgtttgntggtggtttaaagtggtggggnggggnngggttnnngttggtgtttgggtttgtttttttnngggtttgngtgtggggtgggggggggtgtgggtttgttggtggggtnnngngatttttggnggggggtnnggngggggttggggttttggaggggggggtgngtggggggggggtgggtggnggttgggggggggggtggggtntggggggtgnnggttttgtggttgtgggtgttggttgtggtggggggggtgggtgttagggtttgtgggggggtgttgnggggggggtgtgggggggggg

SEQ ID NO: 17338 - DNA, 581 bp, Zea mays
  unsure (1)..(581): unsure at all n locations; Clone ID: LIB3279-008-P1-K1-F2.R2
gctttcgccccgcgtccgccccgcgtccggcccgcgtccgccaccagcaaatccccaattcctccgagttcgagcgaccatgtcggggcgtggcaaggtcgggaagggtctgggcaaaggcggcgccaagcgtcaccgcaaggttctccgcgacaacatccagggcatcacgaagccggggagggggaggctggcgaggaggggcggcgtgaagcgcatctcggggctcatctacgaggagacccgcggcgtgctcaagatcttcctcgagaacgtcatccgcgacgccgtcacctacacggagcacgcccgccgnaagaccgtcaccgccatggacgtcgtctacgccctcaagcgccagggtcgcaccctctacggattcggcggntgagaggcgctaccgccgctggtggccgtggcaaaagtcttgggtcgcggtcaagaaatcgagagtattctggatgacgtgcttagtttcgtagtattattatcactagtgcttattgttagcggttgttgggttcgaccactctaagccactgtcaaacagtaatatatgagtaccgaatttccgtgtttcg

SEQ ID NO: 17339 - DNA, 600 bp, Zea mays
  unsure (1)..(600): unsure at all n locations; Clone ID: LIB3279-010-P1-K1-E6.F2
tttttttttttactagcangattacaatgtgttagaaaacttcaacaggggtnactgattcattcagcagttgttacaaattctacattgttggcggagcaacctagcacaggcctaaatttgagaattaaacaggatcgtagcagcggggggggggggccctaagagggtgtaaacttggtaaccgccttggtcccttcggatacggcgtgcttggcgagctcgccggggnggacgaggcgcaccggggtctggatctcccgggaggtgatggtgggcttnttgttgtngcgggcgagcttggcggcctcgggggcgagcttctcgatgatgtcgttggtgaaggagttcatgatggacatggccttggacgagatgccaatgtccgggtgcacctgcttgngctccttgaagatggagatcttgtacgtgtggacgctgttgttgggcttcttctttgcgttgtttgtcgccgccctccttgctgggnacgcgcttttccggccttggcttgttattgggcttctgctgcgggggtttcttttccgcgggcttcttttcggccttgggcgccctcaggaatcgatcaaatggtcgggg

SEQ ID NO: 17340 - DNA, 639 bp, Zea mays
  Clone ID: LIB3279-010-P1-K1-E6.R2
ttcgcgccgccactcaccagcaaattcccgagccgccccttccccatctctttcgcgacccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatttaggcctgtgctaggttgcttctgcaacaatgtagaatttgttataattgctgaatgaatcagttacccctgttgaagtttctaatatattgtaatcttgctagt

SEQ ID NO: 17341 - DNA, 575 bp, Zea mays
  unsure (1)..(575): unsure at all n locations; Clone ID: LIB3279-011-P1-K1-H6.F2
ggaaaccagattggtttagcngaacagaggaagcaggacgcttcctcttcgttcacggttccttggcggggccnagcnaaagaacatgcttcaacacactctggaacacaccacgggggggggggcgcagagacccttggcacacgagggctgacggggccccatcagtccagttcaccggctcgggcgctcggagccagatctacgccttggtggccttcttgggggacttggtggccttcttgggcgacttgggggcggtcttctcggccttctcagccttctcgggggccttcttggggagcagcaccgggttggtgttggggatgacgccgccgtgggcgatggtgacgccggacagcagcctcccgagctcctggtcgttgggggtggccngcagcaggtgcctgggcacgatgcgggtctttttgttggccttgggggggttcccggtccgctcctgcccctttggtgggaggttctcgaggacgggggcgaggtagacgggggcgcctggacccacccggctgggcgtaacggccctttttggggagcgcccgatgcggccgtcgggg

SEQ ID NO: 17342 - DNA, 617 bp, Zea mays
  unsure (1)..(617): unsure at all n locations; Clone ID: LIB3279-013-P1-K1-H3.F2
agcaagcagggaaggcacggatacaactatattccaaaacaggggcgccaaatctaagaggcccattacaatccggcacgatttatgaagcaggcaagctagctactggcctttgttcacccgacgagaacatcaacggttgcacagcacatacataggcggggaggggaggggtagaggacacgacgaagaacccttgtaagaaggggagacctaacaaatccgtggacgctggaggctgctcaattgctggtgaacttggtgacggccttggttccctcggagacggcgtgtttggcgagctctcctgggaggacgaggcgcacggaggtctggatctcgcgggaggtgatggtgggcttcttgttgtaccgggcgagcttagcggcctcgccggcgagcttctcgaagatgtcgttgatgaaggagttcatgatggacatggccttggaggagatgccgatgtcggggtgcacctgcttcaggaccttgaagatgtagattttgtaggtctccacgctcttcttggccttcttcttcccctttttctcgccgccctccttgccggnagacttcgaggcgggcaggcgcttctcggacttgggcttcttacctgc

SEQ ID NO: 17343 - DNA, 683 bp, Zea mays
  Clone ID: LIB3279-013-P1-K1-H3.R2
cgacccacgctttcgcgagtctccagccaaccgcatccagtccaccccatccccctcgaccccgacaaccccgagtcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctccaaggccatgtccatcatgaactccttcatcaacgacatcttcgagaagctcgccggcgaggccgctaagctcgcccggtacaacaagaagcccaccatcacctcccgcgagatccagacctccgtgcgcctcgtcctcccaggagagctcgccaaacacgccgtctccgagggaaccaaggccgtcaccaagttcaccagcaattgagcagcctccagcgtccacggatttgttaggtctccccttcttacaagggttcttcgtcgtgtcctctacccctcccctccccgcctatgtatgtgctgtgaaatcgttgatgttctcgtcgggtgaacaaggccagtagctagcttgcctg

SEQ ID NO: 17344 - DNA, 302 bp, Zea mays
  unsure (1)..(302): unsure at all n locations; Clone ID: LIB3279-014-P1-K1-D8.F2
ggccccccttggtggcgatttccattggtgccccccncggggttggcttggtttgggacattgctgntcngttcacctctccttcnccacgtcccgcccgctgggggggggctgccgtgtagagcctgcgccccgggccccggcctttccggccggccgccttggcgcgctccccggggttgcggggggcgagctggttgtccttgggcttgatggtgacccgcttggcgtgggtggcgccggggttggtgtcctctaaccggcccgcggggtgggccttggcggcctcctgctccgcggcg

SEQ ID NO: 17345 - DNA, 395 bp, Zea mays
  unsure (1)..(395): unsure at all n locations; Clone ID: LIB3279-014-P1-K1-D8.R2
ccgcaagctgcccttccagcgcctggtccgcgagatcgcgcaggacttcaagaccgacctccgcttccagtcctccgccgtcgccgcgctgcaggaggccgccgaggcctacctcgtcggcctgttcgaggacaccaacctctgcgccatccacgccaagcgcgtcaccatcatgcccaaggacatccagctcgcccgccgcatccgcggggagcgcgcctaggcggccggccggataggccgtggcccgtggcgcaggctcttctcggaagtttgtactagtggtcgggtcgtgtggaaggagtggtgtactgatcagcaatgtctcaaaccatgtcaacctctttgttgtcatcaatggaaatcgccacttatgtgtgctnnnnnnannnnna

SEQ ID NO: 17346 - DNA, 542 bp, Zea mays
  unsure (1)..(542): unsure at all n locations; Clone ID: LIB3279-050-P1-K1-G12.F2
agggagaatgggaaagctttcccacctggttttttttctttnancacacgggcttctgggnacagagcaaatgtgctgtcgtgggaggccgtgctcctctccgtggggggaaagaaccaattcggggggggggcttggttnatttttgttaaatggttctcttatacggggtaagactgaggagcgtcagcttgcttattgttcagattgtgngttgggctggccggccgatggcggtgtgccngacaagtgaatgatcaccaagtgcggggcgttccccccttacgcgttgtaattcatgctggtcttcttctttgcctgctcttgggtgatcccgttgttgaaattcttgtgggtgacctgtggagcattttggggtngagcgtgcttgccagtctttgcgcncacagcctttagctgagcgccattgaaatatgggttgggcgcgcgaatttttaaagggacatctggattgaatttcattttcttcgagggatctggggattttagcttctgcttcctctgttgggtgagggaactta

SEQ ID NO: 17347 - DNA, 367 bp, Zea mays
  unsure (1)..(367): unsure at all n locations; Clone ID: LIB3279-055-P1-K1-D2.F2
tccnnngtnngcgtggttgggcgtaatgcaaaatcctggcgggggccccnnnncctgggncngtgtttgaccatngtncgagggcgcagctcatccgttctgggtctcttgtcctttancnntctanngctcagtggggggggggggcatcgnctttanctctaggtggccttgtctgccttggtggctgtggctgctggttgtcccctgtgccttcctgtgctgctngcgggggtgagaccnaccttctggcctgggggagcgtttcgggggccagttgaggcgtgaccggtgtgttggtgggttccttctgcgtggggttgctgctgtgggtttatggacactccacgcgccttgggccgggtgt

SEQ ID NO: 17348 - DNA, 636 bp, Zea mays
  Clone ID: LIB3279-055-P1-K1-D2.R2
gcgttcgtcccgccgcgccgcctcaccgccgccggagaagagggtcgcgtgatccgcgcgcagcgtaagggtgcggggtccgtgttcaagtccccacccccaccgcagggccccgcccgcttccgctccctcgacttcggcgagcgcaacgggtacctcaagggcgtcgtcaccgacgtcatgcacgaccccggccgtggcgcgccgctcgccaaggtcactttccgccacccattcaggtacaagcaccagaaggagctctttgtcgcagccgagggcatgtacacgggccagttcgtctactgcggtcgccgcgccaccctctccatcggcaacgtgctgcccctccgcgggatccctgagggtgccgtcgtctgcaacgtcgagcaccacgtcggtgaccgcggtgtcttcgccagggcctctggggactacgccattgtgatcagccacaaccctgacaacggcacatcgaggattaagctgccctctggcgccaagaagattgtccccagcagctgccgtgctatgattgggcaggttgctggtggaggcaggactgagaagccgatgctcaaggctggtaacgcgtaccacaagtaccgtgtgaagaggaacagctggcccaaggtgcgt

SEQ ID NO: 17349 - DNA, 515 bp, Zea mays
  unsure (1)..(515): unsure at all n locations; Clone ID: LIB3279-060-A7-F3A
acacagtcatcgaatcgaatttagcctacagaacagataaaaaatgaagctgatgcaagtgacagcggcaaaactccctctggtacttgcgttatatgtctggatgcccctgtggaaggtgcctgcatcccgtgcggccacatggctggttgcatgtcctgtttgaaggacatagaatccaagaagtggggatgccctatctgccgtgccacgattaaccaggttgttcgcctctatgctgtttgaggagttgaaacggtgggttcagaaagttggcaatggattggagggttctcgcaacaaatgttgatgggaacgtctctatctcaaaattgtgcaattatgctatttttgcacttcgtactgcactacanatatgacttccgtgtaatgtatgtgggctgacgcctttatgtacataggtagtactatacaagacaattctataaaaatctgggtattggtgcaagttgcaactcacgttcaaagttgcacgattgtggagcttttccaat

SEQ ID NO: 17350 - DNA, 813 bp, Zea mays
  unsure (1)..(813): unsure at all n locations; Clone ID: LIB3279-191-Q1-K6-A1
ccgggttcgnacccacgccgtccggtaaaactagnaaaagggctcctcccgnaccccgcaacgcccnnctcatctccctttcgaccccgnacatccccgnacccgnatggggcgcccaagggcggnagnaagaaagnnccagcggnagnaagnaagnnccggcgnngccgagggagnaagggcggnagnaagnaacgacnncgcagggnnaagnaagnncccaaggnnccgnagnannagcggcttttgcccgcgnnntccaagntccctnnccggnncaaggggagggnncggcgaggnaagnaaggggggaagnaagnaaggggccaagnaagnagnncgtggnagnacccnntacaagnnatctnnacatctnntcaaggtnnngctgaagcnnnaggtgcaccccccgnacccatcggcattatttcctccaaggcnnncatgtccnnatcatganannctccttcnnatcaacgacccatctttgnnagaagctgnngccggcgagggccccgccaagctgnngcgcggtaccaacaagggatagcccaccatttcacgtcnnnccgcgaggaatccagnatcctnnccgtgccgcnnctagtcctttccccggnagnggggctcgcccaagcacccgccgtctccggaggggaacccaagtgtccgtcacccaagtttcaacccagcaactttgagcgcggctgtcgggatcccgcggnatctgttagnaaggggttcttttgctgtgttccttttcccccagtccccccaccctaccccgccttgatggctagccttggcctgctc

SEQ ID NO: 17351 - DNA, 596 bp, Zea mays
  unsure (1)..(596): unsure at all n locations; Clone ID: LIB3279-191-Q1-K6-A10
ggctaatgacgaccagnanaatctccatacacagtggcggatgcaggacaaaattcatggggggccaaaaagacccatgagagctatggttttctagttcgtcaagcctgccngaccccaggggaagtcatatcgttgcaacgagggagatctatcttgtcgagtggattgacatcacgataaaaacaggacaggggacagaggcgtcaggaagggatggagtcgggtggcgtcgcatcgggaatgggtcaacaacggaaacggggcagcgagcagactggtttaggtggtgtcggaaatgttgggcgccttcggcttccgaaggtcctcaaaaacatgatttaacaatgcctctggagtataatgtgtggacagggatcttcgaacaagagcccacggtatgaagaagcacggaaataatacgaaagatggagcagagccgaagctgcgcagaagggagcttcggcatgatggcagaaaagaggaaaccgacttaaagaggaaaagactatctagacccagataaattactatagagttgttgtcataggcaaagggcctgggatgtaattttgcatgggctgcgacccgtgcct

SEQ ID NO: 17352 - DNA, 542 bp, Zea mays
  Clone ID: LIB3279-191-Q1-K6-A11
cggccgcgtgggcggacgcgtgggcggacgccccgtgccctgcaggtgccagcgccctgcccgcgccacccagcagcgaccgcgcctgctccctgcgcaagcagccgagccgccctgcatcgacgagtccaagcgccatgaagccgccaaccaagcccgacgaccccgcccaggcggcgaccgagcagctgcccgaccccgtcccaaggacgcgactccgaccggcgcgatgcaagcccaagaccgcgcgcgtctgttcgattacgtgcgcgattaatggtgtttaaatcctccgttactccttctcccatttctccccattatgagcagaaaaccgacgccatcaatggccagtgaaggccgtcggcgccccatgacctccctggcgtcctttcccctctcccctccctctctctataaaagggacagcagagctctctcccatcctccctacccgagctctctcccattccccgcctcgctctctagctctcctcgctcatcgctagtgccgttcgtcgccggagtttgccgctcgtcgc

SEQ ID NO: 17353 - DNA, 666 bp, Zea mays
  unsure (1)..(666): unsure at all n locations; Clone ID: LIB3279-191-Q1-K6-A12
agcgtccggccgaggaggagttggaccatttctaccgtgttctcgccattaagactgacatgctgtttagagcctaccctgaacacaagccgtttgcagtttctgaagaggacaaggccgtgcaggagaggttgaaggaatttgcgaacgaatgcatcgacctcctggatgatgcgttgcgccgcatccccgcggagaaaaggcgcccactgttctcggtgtttggtaatgtgtaccaggtatttgcgtcagtaaagtggtatgcggagggggggtgtgcccagtggtggatggcgctgcagatcacggaggagcttgagatcatgcgcaagatggtgtccagcgcttgcggcggcacccctcttgacagagagacggtgttcgacaggaaggaggccctcaccggtgtcgacgttcaggcggcgctccgcggccacggcgtcgagagcaacttatcactggtgatcttcgagctgatcgacaacatctacagcaatgtcaagtcggacatcgatgacatggtcttcgctttcactgcttagacatcgttacctacgtgtccacaccacatggagcttttcagtcaccaccctcaaatctncaagtgattaggatctctgctacactgcttttactaccctaactcaattttgatgtgatcggctg

SEQ ID NO: 17354 - DNA, 558 bp, Zea mays
  Clone ID: LIB3279-191-Q1-K6-A4
cccacgcgtccgcccacgcgtccgctcgcatcttcctccgtgatccaagttctagcagcgcagcgctcggtttcgacaatatgtcggggcgcggcaagggcggcaagggtctgggcaagggcggcgccaagcgccaccgcaaggtcctgcgcgacaatatccagggcatcaccaagccggcgatccggaggctggctaggaggggcggcgtcaagcgcatctccgggctcatctacgaggagacccgcggtgtgctcaagatctttctggagaacgtcattcgtgacgccgtcacctacaccgagcacgcccggcgcaagaccgtcaccgccatggatgtcgtctacgcgctcaagcgacagggccgcaccctctacggcttcggcggctaggtcgcttcgtcatctggtggcgaactgcatgtgtgtcggcggtggtcgtgttgtgtgcctaatctagtgtagtccgttctctatatcgtcgctgtgttctgtggtgtcttgtatcccatttcctgcaataccaacttgccattatcaatggaaaacccctcgtttc

SEQ ID NO: 17355 - DNA, 661 bp, Zea mays
  Clone ID: LIB3279-191-Q1-K6-A5
gctgttcctccgaggcagcggcggcgggggcggtgggttcccggtggtggcgtgggaggtgttgcggcggcacttctctaagaagcggtccgtggacgtgaggcggatcaaccccaaggtgcccaaggaggaggccgtcgccatttccggccgactcctccagatcctctccgaccatgggcccctcaccgtcgccaacacctggaaccacgccaaggatgctggcatcgctggcctgaacagcaagacgcacatgaagatcctgctgaaatggatgacagggagaaatgtcgtgaagctgacctgcgtgcacgtgggcaacgcgaagaagttcctctactccccgtccactgaaagcagcagcagcagcgccggcgcatcaccgtcatccacatcggcctcgcagtgacggtcagtcgctgttaagccttggtgtggttcttgatgttgctttgtggatcgatggaggttgcctctggtcattcggatcccatgtttaaccttgatgacgaacattggaaaaagcattttgttttatggactggaatagtctgcaaacatcacgatagcaatattgttctgctgctcctcagctgaggatgctgccctgtcctgaactcctggatttgcttttgatctactatgtgatgatttgctcttc

SEQ ID NO: 17356 - DNA, 611 bp, Zea mays
  unsure (1)..(611): unsure at all n locations; Clone ID: LIB3279-191-Q1-K6-A6
ttcttcccgnacgacctcatcaagcgagggcatggccgttccagatccgtcgagcccctacaaggtgcggctgctgatcgaggactacccgtacgcctcggacgggctggccgtgtggcacgccatcgagcagtgggtgacggagtacctggccatctactaccccaacgacggcgtgctgcaggccgacgtggagctgcaggatgtggtggaaggaggcgcgcgaggtcgggcacgccgacctcaaggacgagcactggtggcccaagatgcagacggtgccggagctcgtgaaggcctgcaccaccatcatctggatcgcgtcggcgctacacgctgccgtcaacttcgggcagtacccgtactgcgggtaccacccgaaccggccgtccgtgagccggcggcccatgccggtgccgggctccgacgcgtacaaggagctggagaagaacccggagaagttcttcgtgcgctccatcaccgcccaattccaggccgtcgtcggcatctcgctgctggagatcctgtccagccactcctccgacgaggtgtacctcggccagcgcgacaccaaggagtggacgtcggacgccaagggcgcagaggcgttc

SEQ ID NO: 17357 - DNA, 630 bp, Zea mays
  unsure (1)..(630): unsure at all n locations; Clone ID: LIB3279-191-Q1-K6-A8
cgtccgtgtaaacctcacctcttcccttcctccccgccgccgccaccgccggaaggagaaaaaaatgggtgccgatggggaagaagcgtcgcggatagtcgtgccaatggcggtggaggggacctcggagcagctggcgttcgtggaggagtcgaagctgcagaagcgcaaggagaacgcggactgggccgtcaggaaccgggagcgcagggcggtaaagcgccagcgcatccgcgacgagcacaaggtcaccgtaaggcggcccgaggacttcgttgcggcgttccggaacaaggaacgcgacttcctgcggatgaggacccgcctcaaggtccgcaagcagccgcccgccgaggcgctcagctccaagctcgtcttttcaattcgcatccctggctccgtggacttgcatccgcacatcaggaaggtcttgaggaagctacggctgacgacggtcctcaccggcgtattcctcagggccaccgagctgacgctgaagaggcttcttgtggtcgaaccctttgtcacctacgggtttccaaacttgaagaacgtgaaagagcttatttacaagaagggccgtgggtttttcgacaagnagcctttccctcttaccagtaacgatctaat

SEQ ID NO: 17358 - DNA, 516 bp, Zea mays
  Clone ID: LIB3279-191-Q1-K6-A9
ctttggcatgctcaagtttatccattatgctttactttcatgttcaacactcagcaaattggttagtcctttaatattggcgtcattcaatccaccaaaacccacaagggaactaaatacacttttacttaactttgggtcgattgtacaaacaaataataggttaattaatggatcatctgcttgctgaaggaatcacactatggagtaggagtgtttattatatgaccattcggatgggtaatgggagcaacaacacgatcaactagagaaggtgttatatatgtattttggtgcgtgcttactggtagcctgtggtggtttacatacaatcttacataataagactgttaatgcttatctaatgtgtagagtgtattatcaaatgaggagggtaaactcatggacaactccactatagcaaggatatagatgttgtggtgatacgataatctatgtatactgacacatgctacacctaaacaccataatatcttaggaagcttgttttggatc

SEQ ID NO: 17359 - DNA, 620 bp, Zea mays
  unsure (1)..(620): unsure at all n locations; Clone ID: LIB3279-191-Q1-K6-B1
ggtgttccagnaacttgctacagccatggtggcaaacaaagaggtcccgacaaattttcagcccccagacatgttggacaagcaaataggactcctcccaggcgttgtgttcgactccacacctcctggggtggagttcggagatgtcagctcagacgtccccgcaagctcaactttcaggaagggcagtgtcgtgaacgctacattctactcggcgtgcccgaggaatgaccttctcacggacggcacgttcgcgctcgttgagaagctggacggcagcaacagctgggttcctgcctacgacgacgacgactggtcactacgcttcaagtggtcgagaccgtcgaagctgagcccgagaagcttcgcgacgctggaatggaccgttcctgaagacgccccgtcgggcgtttataggttgaggcattttggtgcctccaaaccactgattgggtccatcaaacattttacggggacctctcgggcgttcgcagtgcgttaggtaggtagcacaccgttgcgttgcgttcgacggcacacctgccagagaatctgaccccggtcatatccttactttggataccttgcccagttttggccatgttttccctatggtttta

SEQ ID NO: 17360 - DNA, 628 bp, Zea mays
  unsure (1)..(628): unsure at all n locations; Clone ID: LIB3279-191-Q1-K6-B10
cagtgggtngagatactccaccgagttcattcaagagacgacggcagtcccttatggacgactatgtgggctcgggaaagcgtaagagaggctgaccacgtttggcatcctcccttactcgccaggacatgccgtctctacaatgataagaccctgccgcgcagtagtgcttagttcctcttgcacgtgagtcgaatacctgactagcgtaatttatgcaatgatgacataggttagttattaatcctaaatggagcatgtatgtgcatgctgtgttagtgtcgtagatctggacaactgttgctgcccagctgacacagatgcctttcgctgcaatgcttccggtcctgcattttgccgcaactgattttgcaaccaaggctaaacccaacgcgggcagtagtaactgttgcactcaggatccacgtacacaaaaatgagttgaggctaataacgtccctactcggctggtggtatatgttaagagccaatcatgtttaagctattactctgatcgttaaggtgcatcggatcgctaaggtggatctaactgtttgaactagaatgtaaagtgagaactgaaatggaagaagtacctttgcatcgatttgtgattggaatatatata

SEQ ID NO: 17361 - DNA, 613 bp, Zea mays
  unsure (1)..(613): unsure at all n locations; Clone ID: LIB3279-191-Q1-K6-B11
gcaaagtctaagnatgttcacaatgctttgacgagggaggactatgtgtgctcctcaattcaaggatcccttgaccaatcagnagnagggaaaagataatacaggaattcaaagatggctacaccaaggttcttatatcaaccgatgttcttgctcgaggttttgaccaagcacaggttaaccttgtcatcaactacgacatgccaatcaaatttggtacaagagatgaacctgattatgaggtgtacttgcacagaattggcagagctgggcgctttggccggaaaggtgctgtgttcaacttgctgtgtggtcaaaccgataatgttgtgatgaagaagatcgaggactatttccagcacagtgtgcctgaggttcggaattggcaacgtgaagaagattttgaggctgctctcaaggatgcaggtttactttaaagtaaccacggaaacttgtggtgttttttgctgagcctgctgcacaacgttattgtgctctttctgctctcctgttggcagcactgattttcaccggtgattttttttcgctgagcgtgctgcacagcgttgctgtgctcttatgttcatcctgttgtcagcactgattgttttgc

SEQ ID NO: 17362 - DNA, 650 bp, Zea mays
  unsure (1)..(650): unsure at all n locations; Clone ID: LIB3279-191-Q1-K6-B12
gttacttctccctccgccgccactcccctcccattcaccgccaccgccaattccataccgtgctccgccacctctgctgagagcgagaagagatggcaggcaagggtgatgggccggcaatcggcatcgatctcggcacgacgtactcttgcgtcggcgtctggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgactcctctgtccagagtgatattaagctgtggcccttcaaggtcattcctgggcccggtgagaagccaatgatagttgttcagcacaagggggaggagaaacagtttgcagccgaagagatctcctctatggttctcatcaagatgcgtgagatcgctgaagcttaccttggcagcacgatcaagaatgctgttgtcacggtccctgcctatttcaacgactcgcagaggcaggccacaaaggatgnnctgggtgattgctggcctcaatgtgctgcgtatcatcaatgagccaaccgctgctgctattgc

SEQ ID NO: 17363 - DNA, 660 bp, Zea mays
  unsure (1)..(660): unsure at all n locations; Clone ID: LIB3279-191-Q1-K6-B2
gtgttttggaggcaatttgccatcccactgccaccgcatctgaccgaccacacacttgccgagttccagggaagggttatgctggtgggtctgctgtgcaaaatgcagcgacctgtgtctgcatttgggagttgcagaagatgactctcctctggaaggaggtggacagaatgccaaatatctggtgcttagagttctacggtaagcacatgaagatgacatgcctgggcaacagtggtttgctcatgctctccttgaaggcgaagcgtatgatccgccttgttacatacaaccttctgaaaagggagtggcaaaaggttcctgattgcgtgctaccatacagccgcaaaaagcaatggatagcgtgtggcacagcatttgatccggtcccctgcgccttgacctgacatggaatttaccttctttgccctagtnccataatactatagtgaatccgtatcattggcctatatttttagatctttctaatgttgttatgatgagctttgcaaaaccgcgttcactgtgatttgttttctatcacgctgacgcatttgaaccgtttcctttgatcacctgctgctacttgggtcactgctccattaattgggcaagcccgcctgggtttgtttcattggaagtaaaaacggaacgccaggt

SEQ ID NO: 17364 - DNA, 621 bp, Zea mays
  unsure (1)..(621): unsure at all n locations; Clone ID: LIB3279-191-Q1-K6-B3
gcaccacttccaaactatagttcagatgtgcatgaatgtgattctggttagcattgagctggggcaatatgcacatgtttcaaactatgtcagcaaagcagagcaaacccccgactctctggatcctaccattgttgcaaagctgaaggcagctgcaggattagccaacttggaaacaaagaaatacaaatttgctgctcgtaagtttgttgagacaggaattgaactaggaaacaacttctctgaagtcatagctcctcaagacgtggcagtctatggtgccctttgtgcacttgcttcttttgaccgttcagacctgaagagcaaagtcattgacaatatcaacttccgtaactttctggagctggtgcctgaagtaagggagctggttaatgatttttatgcaagtcgctatggatcttgcttgggtcatcttgagaagctaaagcctaacctgctcctggatatccatttgcatcagcatgtagagactctgtatatggagattcgccacaaagcgatcatacagtacacacttccttttatatctgttgacctcaacacgatggcagccgnctttaagacttcggtctccatgctgcagaaagagctggccgcact

SEQ ID NO: 17365 - DNA, 525 bp, Zea mays
  unsure (1)..(525): unsure at all n locations; Clone ID: LIB3279-191-Q1-K6-B4
cgtccgttttgtaaactatagnnaagcccagggcagnnttgttcccactctgtgcaaatagnagattggctagggctgccaactttcccccgntcagccattcacaaatttntagttgggattcaatgaacgacaaatgcaaagagcaggngttgaaaattgagattggccatccgtatatgcttctctctctctctctctctctctctctcttgtttgtggctctcaatctatctttggttgtatttgaatcttgtaccgggatccaatgcatagccttctcnatctggagggattctagagctttgatctaaaaaaaatttaanaaaaaaaaaaaaaaaaaaaaaaaaaaaaaaccaaaaaaaaaaaattttaaaatttttnnaaaaaaaaaaaaaaaatattaaaaaaaaaaaaaaaaaggccnccctttttaaaggttccaagtttacttacccttccttccaacttctttctttttttttattttccccctaaattaaattaactgncccctctttttac

SEQ ID NO: 17366 - DNA, 597 bp, Zea mays
  Clone ID: LIB3279-191-Q1-K6-B5
ctccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctctcccccgacgagcgccacttcatctcccacgtgctcgccttcttcgccgcctccgacggcatcgtgctcgagaacctcgcctcccgcttcatgtccgatgtccaggtcggcgaggcgcgcgccttttacggcttccaaatcgccatcgagaacatccactcggagatgtactcgctgctgctcgagacctacatccgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttc

SEQ ID NO: 17367 - DNA, 207 bp, Zea mays
  unsure (1)..(207): unsure at all n locations; Clone ID: LIB3279-191-Q1-K6-B8
ttttgttcgcgagcggcgagagacgggcaggggnagagaaaaaaaaaaatctaaccctagcatccgcagcgctagggttcgggggttgcgatggcggcggtggtggtggcggctgctacaactgcggccaggccggccacatggccagggactgcccaagcggtggcggcggtggcggagggaggttcggcggcggcgggggtggag

SEQ ID NO: 17368 - DNA, 505 bp, Zea mays
  unsure (1)..(505): unsure at all n locations; Clone ID: LIB3279-191-Q1-K6-B9
ctctgngnggactgttcatcattgacaggagggagtgattcagcactctaccattaacaaccttgccattggtcgcagtgtggacgagaccatgaggacccttcaggcattgcagtacgtccaggagaacccagacgaggtctgcccggccggttggaagccaggggagaggtccatgaagcccgaccccaagggaagcaaagagtacttcgcggccgtctagactcgccgtctttgagaagctttgctacgtttttgtcatggtgcccgctaagccccccggcagtaggttggagttttgcggagctcgcgtttttacaaatctctgtgctctgaaacgagcgtcgtagccccctttgctgttgtgcatcccgattgagtgctgttctttgccaccttgtttaatttcgtcacctgacgacataaggttcattttacacgtgattgagagatctcacctctagtcttgtggcgtagtttgtcggaaaaatccctatatgtcatc

SEQ ID NO: 17369 - DNA, 447 bp, Zea mays
  unsure (1)..(447): unsure at all n locations; Clone ID: LIB3279-191-Q1-K6-C1
ttttcttcttcccatctcccgatccatcgcaacccaaaccctactccaggcagatctccgtctccgccgacgctgccggcgtgagcacagcatcagatccgctgtgatggcgttccgccgcatcctatccaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgttgccgtttgaccgcttcgccggggccgtcttcgcctggctccggcggctcgagcccccagacccgtgcttgctccggttcgcctgccccgtgccgttccgcgcgggcctcttggtctttcttgcggtgcctgtgtcccgggcttccnctctgcccagcggcctgcgcttcgcttcgtgggtttcccttgg

SEQ ID NO: 17370 - DNA, 636 bp, Zea mays
  Clone ID: LIB3279-191-Q1-K6-C10
ctttccccttccctccctccctctccccgcgggccgccagaggcaatttcgccctcgattcgaccccgattcgtccgcccgcgaccgggattccctccgccaagcgcggatctgaacgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaggaagaggaggaagacgaagaggagtctgacaagtccaagtcggaggtcaatgacgaggatgacgaagagggtagcgaggaggatgaagatgatgacgagtgatggagagctcgctc

SEQ ID NO: 17371 - DNA, 522 bp, Zea mays
  Clone ID: LIB3279-191-Q1-K6-C11
cggtcgcgtgggttcatgattctgtcagtatacgcctttactttatgcatggttactggccttacccatttttgtggtgttaggatgaaattctggtgaattgtaagctaccatttgatatgatgtattcattcattaacttgtcaacaaactggtagctagcttgcttgaaatataatactacgtctgatctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaataaaatttacctaccgggggttggaaaacaaatattttttttttggggcccctaaaataaaataactgggccgctttttaaaaacttggaaatgggaaaacccttgggttccccaatttaaatcgtttgggagaaattccctttttccccggttggtttattaccaaaaggccccatacctttccccttccaaaaa

SEQ ID NO: 17372 - DNA, 284 bp, Zea mays
  unsure (1)..(284): unsure at all n locations; Clone ID: LIB3279-191-Q1-K6-C12
tcacccccgncatcgactgcgacaagatcgaatgaagggatactgttcccttaccagaatccatacgacgggatggtgatgttcagtgccctgctagcagtaggctgcatctgcactgagtgactagaataaaggatttggtgatgtttgtgctgattggtgtgttcgcctgtaatcgtgtgatgccgtcgttggcttcttatatccgtgtctaatctcgcaagtgctcgtgtttgcaactataccatttataatgtcaacttatcatgcttgtcattcgattc

SEQ ID NO: 17373 - DNA, 635 bp, Zea mays
  Clone ID: LIB3279-191-Q1-K6-C2
gcttatgtaaacttgatatgtgttaattcttgttgtttttcctcttgttgtatttggtatacattcatctgaacaatttcccgtttctcctactcgctgccctcttccttgtttattcctctaatgtgttgctgccttgctgggtaacaagtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaagctgctaaagaggaagccagctccataagtaacattattgctcaggctacaaaatgaagttcttcatgcctgccccccttccctctatcttgttattggtgtacaagcaactgtaatgcactggactgcgagttcatttgctctgc

SEQ ID NO: 17374 - DNA, 572 bp, Zea mays
  Clone ID: LIB3279-191-Q1-K6-C3
ttgttatcaggaaggacctgtacgggaacatcgtcctcagtggagggacgaccatgttccctggcatcgctgacaggatgagcaaggagattactgccctcgcgccgagcagcatgaagatcaaggtcgtggcgcctcctgagagaaaatacagtgtttggattggtggctcgatccttgcgtcgctcagtacgttccagcagatgtggatatccaaggatgagtacgatgagtctggccctgctatcgtccaccgaaaatgcttctgagctagctatctgccgcgcctttcatagcgtgtcaagctgttgagatctgcgttgttgagttgagtgtctctatggagtatcacatactttctgcatgaggggggaagagtatacccaactaagcgcatgcctttcggatgccctgcttcgtgattcagatgctgctttctttcaagtgatatgtcgatgtagtgtgcgagcaatgtatttggtttggctacagctgttcctgtcgtctgtgcgtaaaacattagctatgtatctatccatatctgcatatttgaatgtatggtcgttttctca

SEQ ID NO: 17375 - DNA, 358 bp, Zea mays
  unsure (1)..(358): unsure at all n locations; Clone ID: LIB3279-191-Q1-K6-C4
cggtcgcgtggngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggtgaggttgtggggagatcaaagtttaacgtacgcgggcttgcgaaagtattttttttttttttggggtcccttaaatgaaattaatgggccgcggtttaaaaaggtcgtgatggggaaaaccggagctttcccaaatttaatccctttgcagcacttccccttttcgcaggttggcgtattggggagggggcccgcccggttgggctttccaaacatttgcgcanctggatggggaatggg

SEQ ID NO: 17376 - DNA, 618 bp, Zea mays
  unsure (1)..(618): unsure at all n locations; Clone ID: LIB3279-191-Q1-K6-C5
cccggcgtgcaggaggaccccgcgtgcggcccgctgctggacgccgtcgccatcaaggagctgcccgcgccgtacccgaccaaagacaacctgatcaagaacgacggcttcgagatcggtccccaggtgctcaggaactcgacggtcggcgtgctgctgccccccaagcagaaggacgcgacgtcgccgctgcccggctggatcatcgagtcgctcaaggcggtgcgattcatcgacgcggcccacttctctgtccccgcggggcagtacgcggtggagctggtggccgggcgggagagcgccatcgcgcaggtcatccgcaccgtgcccaaccgcgcctacaacctgtcgttcgccgtcggcgacgcccggaacggctgccacggctctatgcttgtggaggcgttcgcgggcaacgtcacgcagaaggtgccgttcgattccgccgggaaaggtgggttcaagacggcggcgttcaggttcgtggccggcggcgtccgcacccgcctcaccttctacagctcctactaccacaccaaggtcaccgacngcgtctcgctctgcggccccgtgctggaccaggtcaaggttgtgcctgtcaaggcgtagtgaaatgca

SEQ ID NO: 17377 - DNA, 653 bp, Zea mays
  unsure (1)..(653): unsure at all n locations; Clone ID: LIB3279-191-Q1-K6-C6
agcgcggccgcgtgggctgngagaggcggtggagccggctcccccgccggccaatggttccggctccggcgagaaggaccgcggctcgcgtcgccgcgagggcgacgagggccgcatatcgaagcgctcccgctcgggggaggaccgcgagcggggccggcaccgcagcgttcgggagcaccgggatcgggataaggatgacgggaaggagaaggagaggagccgcgatagccgcgggaaggacaggcaccggcccagagagagggaggtggaacgggagcggaggagcctgagccgttcggagcggcgccgtatcgaggaagaggagatggtgagggagctggagatggagcgcgagcgcagcgagcgacaccactatcgcgaccgtgacgtcaggcgtaggaaagatgacggggcagagccagaagttgatccagaaagggaccagaggactgtatttgctttccagctatctctgaaggcagacgaaagagatgtttatgagttcttctcaagggctgggaaggttcgtgatgttcgtcttatcatggaccgaaactcaagacgttctaaaggagttgggattacacactgaaattttatagtttgctctacatgctgggattatcggcaatttacaagttctaggcaat

SEQ ID NO: 17378 - DNA, 593 bp, Zea mays
  Clone ID: LIB3279-191-Q1-K6-C7
aatccccaaagtcgcccttcccccaaccctatccaaccgaatccagcggcggcggcggcggcggcggctatggcggcggttatgaacgccgatgtggaggtggtcgacttcgacctagacgacgacgacctcatggacgaggatgccgggccggatccagcgccggcccccacctcgcgtctccgctccaccatcgcgggcgacgacgcgccgcgtaggaccaagggccgcggcttccgcgaggaccccaactcctctgcgccccgcgattcgcgctttggcgcggggggacgcgccgacctcgactcgctcggcggcccgggacccatccaatcaattgaaggatggattgtgttggtcactggagttcatgaagaagctcaagaagatgacctccaaaatgctttccaagaatttgggcaggtcaaaaacctgcatttgaatttggaccgtcgtaccggatttgtcaaggggtacgctttgattgaatatgagaagtttgaagaagctcaggctgcaataaaagaactggatggagctgagctttatgaacaaaaaatgagtgttgattgggcctttagcagtggccctgc

SEQ ID NO: 17379 - DNA, 644 bp, Zea mays
  unsure (1)..(644): unsure at all n locations; Clone ID: LIB3279-191-Q1-K6-C8
cggtcgcgtgggcggacgcgtgggaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgttttctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctncaaggtggtcaaggtcgctgactgcggacagctctcctagatctctctgatctggtctgttcggccgccctccctccgtcatcgtcgactcccccagcgtccgttcctt

SEQ ID NO: 17380 - DNA, 209 bp, Zea mays
  unsure (1)..(209): unsure at all n locations; Clone ID: LIB3279-191-Q1-K6-C9
cttcaccaatacgctcgcgnaaataagccacgccagcagttcgttgacacatactgtatgagtactattatactatacggcacaaacggccaaacgccacacaggcgtggatcaaaattgtactagttcctgtctacaattcgtggcctttatcatcctgattggctgcccgtatattatttatcttaagtcatctatattcttatctt

SEQ ID NO: 17381 - DNA, 573 bp, Zea mays
  unsure (1)..(573): unsure at all n locations; Clone ID: LIB3279-191-Q1-K6-D1
cggtcgcgtgggtttccaccttccctcccctccactcccgcaatctcgtctccgccgtccgccgccgcgccgtagcaaggtaacagagatcacaacaagttaaagcctcaaggaatgctgaaagatgtgctttcctagaagatatttctgttgcgacatcaaggaccttgctgctccccgagggctgctcatctgctcaactcttgatgacctgatctgcatggattctacaacgttcagactgcgccacgaccaagccataagagtactgttcaccgtcatggatcatgacatgggggaggaaggctaactctttgcccagtcccacctgattggcgccagcagtgtgatttatactttttgcngagagagaagatatggagtcgacaggaaagattttgatggagcggtttgaggtggggctgctnctggggaaaggcacatttggcaaggtgcacttcgcaaagaatcttgggtccaacgagagtgttgcctttaagatgatgggcagggacaggtgcttcaggccgggctttcggggccggttgggcgggggatcacaacgatgcggtt

SEQ ID NO: 17382 - DNA, 640 bp, Zea mays
  unsure (1)..(640): unsure at all n locations; Clone ID: LIB3279-191-Q1-K6-D10
cccacgcgtccggggngacacagggtttatgcacactatggatcaagttcaggcatgtaatgtatgtgtttgcttgttgttggaaagattgcactattcatggtaatatataaaaccaagagtccctttcctttttctttaatatatatggngaaaacaaaggcaacatccacggcgtgcacgaagagctaaatttttccacagaaaccatcaaagaaaccacatatagtgatacttacagctccactcttcccatattccaaagcagtttggaatgcaacatccattgcatctggcatctcggtgttatctagaagaaaataagttagttagacacaagaatcaatacaaaaggtgttaataagatcagggttcctaaccatcacttttccgtaatacatgtgatatcttctctgcacgatcatatgccttcataaacccactttcaagccaggaaaaaatagaagccgtcggagtgaaatccaatctttgtactaccttcataggtgagtggccactcttagcaaggaaatgttcttgtgaagatttagagaaattttcaccatctgatgtatccatgagcaagctacatgcatcaagtgcctctttccagatagttaataatacaagttcaattgat

SEQ ID NO: 17383 - DNA, 645 bp, Zea mays
  Clone ID: LIB3279-191-Q1-K6-D11
ccagcgtccgcccatgcgtccgggttttttaaacatgttggaagtatatatgctggcaatgcggcgcctattggtctttctagtgcatacagaattttaagtgaagaagaggttgaagcgcagagagattccaagaggcaaaagatgggaaagtggtacttcccacacctgaagcttgacagactcatatgtacctatccttggaacaattctgaactggcagagacagagaaaacagatcgtttgggattagttgatttcttgaagggactccttgaatttgatccaaataagcgatggtcaccattgcaggctctacaccatccattcataacaggagaatcgtttactggtccatatgagccaatacccgagactgcaagaattcctgttgctcgtgcagcagcaattgatcacaatcctggaggggggcactggctacattcaggtctttccccgcaggttggaagtgctaacagatacctacctttgaataatgtctaccctccaaaggttcctttttcttatgggagtagttatggaagctttggtagccatggcagctatactggtaatgctggttttggtaacagctatggaagcattggtgatgctaatgctatcaatatgtattactcacccttt

SEQ ID NO: 17384 - DNA, 614 bp, Zea mays
  unsure (1)..(614): unsure at all n locations; Clone ID: LIB3279-191-Q1-K6-D12
gtgatctctgttgagtatgcacttcgtgatgacgatgaaaaggtgaaagagggaacgggtacagcccagacaggagaggtcgtgaaagatccccaggtagaaggcgttctcctagtccctacggtagaggacgggagagaggtagcccagattacgggagaagcaaggagagggggagcccagactatggcaggggaggacgcagccctgataatggcaggggagtaagcccagctggtggtggcagaggcgatcatgccaggggtggagggcgcagtcctgactatgatcgccagcgccgggaagctagtcctccaggttatgacaggtcccccagccgctcacctgggagggaggccagagagtagaagcagcgttccattccatgcctgtgttcaagcatcagatgaatgtgcaagttggtaatgttagccagcaggaaacttgtctactatgcgcgttagctcgtgtttgactttccaccatttcagtatgaagcgacctcagaatgtaactngttgtagnagattttttttagtggtaggcttttcagtactgggtttgaaccttgntgtngcttttattttttggataaaatgcccacttcgaacttt

SEQ ID NO: 17385 - DNA, 645 bp, Zea mays
  unsure (1)..(645): unsure at all n locations; Clone ID: LIB3279-191-Q1-K6-D3
cccgggttcgacccaacgcgtccggtagtaagcgtnnagtcgtcgccgggagggaaaggcgcggtagcaaggatgtcgtggcagggcgtaccgtcgacgaggcacctgatgtgncgagatcgaaggacagcatctcagcgccgccgccatcgtcggtcacgacggcagcgtttgggcgcagtccgagagcttccccgagttaaagcctgaggaggttgctggtatcataaaggactttgatgaacctggtactcttgcaccaactggtcttttcgttggaggtacaaagtacatggtgatccaaggtgaacctggagttgtcatccgaggaaagaagggcactgggggcattactatcaagaaaaccggcatgtccttgattattggtgtctacgacgagccaatgactccagggcaatgcaacatggtggtggagaggctcggcgattacctgatcgagcagggcttctaaaagttcgtcatgttctgttttggtcatttgggcaccaaagtttgcgcctcatttggttctgtaatccgtgagctcgtgcatgtacttggcgtattgcatgcagtgaataatttagcttgggtttgtttgtttggggcagtgttggggacggatttggattgngggttatgctt

SEQ ID NO: 17386 - DNA, 674 bp, Zea mays
  unsure (1)..(674): unsure at all n locations; Clone ID: LIB3279-191-Q1-K6-D4
ccgggttcgnnacccacgcgtccgtatttccattccaggggcgtcccacnnctcctcaagtacccgactcgatnngctcggcaccttcaaggggccgacgtcaagnaatcgtggacgnnacactaccatcagnncgtcgacggggcaagcccnnatcacggtcgtnnctccagcagggnnnacccgctcaagnnctcccatggggtgnnagctcggcattgacnnatcgtcatcgagggggcaccggagnntcttcgtcgacgggccccgggcgccggcaagcacatccaggnnccggcgcgaagaaggtgatcatcacggctcccgccaagggcgccgacatcccgacctatgtcgtcggcgtcaacgagggcgactacgaccacagcgtcgcggacatcatcagcaacgcgtcctgcacgaccaactgcctcgcgccattcgtcaagatcttggacgaggagttcggaattgtcaaggggaccatgacgacgacgcactcgtacaccggcgaccagaggctgctggacgcgtcccaccgcgacctccggcgggcccgcgcggcggcgctgaacatcgtgccgacgagcacgggcgccgccaaggccgtggcgctggtgctgccgcagctgaaggggaagctgaacggcatcgcgctgcgggtgccgaccccg

SEQ ID NO: 17387 - DNA, 626 bp, Zea mays
  unsure (1)..(626): unsure at all n locations; Clone ID: LIB3279-191-Q1-K6-D5
gtcgacccagcgtccgggttatggagtctgtggagatctgcctttttaagaatgtttttcaagggcagttatgtcccttgaagtctttcatgtattgtgctattcagtaagagttcattaatgngaaaacaacaacaacaacaaagcctttattaatgaaaaagtaaataaaaaaggactgtacacaatatcatttaaatgttgcagtgccttcacctgaaaagttttccagcgatgatgttgaagaatatcctggtgaaatacattacagttcttgtcgcatagtcctaaaccttcatcgcagggctttatctctgaaggttgttaacaaggcagacagacccattcagattggaagccattaccattttatagagaccaatccttatctggtttttgataggaaaagggcctatggcatgaggttgaacatacttgctggaacagctgttcggtttgagccaggggatgcaaaaagtgttatacttgtaagcatcggaggtcataaggtaatcaaaggtggaaatggcattgctgatggtcctattgacagttcaagtcttaatgtggtgatgcagaaggttaatgcaaatagttttggacatgaagatttccagatgcaaggg

SEQ ID NO: 17388 - DNA, 619 bp, Zea mays
  unsure (1)..(619): unsure at all n locations; Clone ID: LIB3279-191-Q1-K6-D6
tccggtaattctaatgaggnnaggattatgtaacctgaaaagtttttttcagtcacttagtagcagggttctattttccggttgttgggttggtgctttccaaatattcaagnnagttttcttccgggnagaaagggcgnccaatattacattattannnaggagctnntgatgatnngttgctttcatgttgcttatagacccaatgaaaaatnnattgctgtcaaaccccctgnatgcctnntcaatcnnnatctttgaggggtggaagtatttgatggtccatcccgatnntctttcaaagctcttatctgacatgngcagcggttcattcattcttgtcgtctttgtatacatattgctaccaagatccatttaaaggaggaaaggactccaaaatttacaaatcgtccttgtagctgttccaccaaaaagggaacaatttaccacttatttatccgagagagagggcggtttaagtcagagagcatttacatgaggccagttaactctgggagccttggaatccgcagtgctcggtaaatttaggtccctcaaccacgttcctgtttggaaggatgaaaggccacctggccttagagggggggatgacctgaaa

SEQ ID NO: 17389 - DNA, 652 bp, Zea mays
  Clone ID: LIB3279-191-Q1-K6-D7
gtatgatgtgccggtctagtttcgtctgggttggcccctctgcttggccgcgtttgtcgtttagatctatccaaaatcatcgtttgttgatttcgaaattggggctgttttgctcatgatttcagttcaaacttcaccatgcttcatgttttggaattgtaattggtggctatgttaattgtctagacaattgtttagacttcagttcagatttgtggacttgctgctgcgtaatgctatcctctgacactggcggtttggttcaataagttgtgcgggcttactattttgttgaattcgatgttgaaatctgttcgttcctagaagggttttgttcaacttgcatattcacttcaacgctccgatgcttttacgtttgttcccttgcccgccctttgacgttgtgcagtttctgaatcgcaggagaaggctccctacgtatctaaggccgagaagctgaaggttgagtacacaaagaagatggacgcctataacaacaagcagtctggaggaggacccacattgtctggtgattctgacaagtccaagtccgaggtcaacgacggggacgaggagggtgatgagtgatggatgaccggtgaaactctgggctgcccaagtgcttgcagtcagcagggaaatctcatcgtcg

SEQ ID NO: 17390 - DNA, 565 bp, Zea mays
  unsure (1)..(565): unsure at all n locations; Clone ID: LIB3279-191-Q1-K6-D8
gtcgccgctgctccgctcggggtccgcacccgcgcgcgcgccctcgcgctgcagcgccttgagaagcagcaggtgcagcaggaggagggctgcggcggtgagtacctggagctaaggagccggaggctcgagaagctgccgccgcaggtggcgtccgtgaggaggtgcggcgggaggaaggtggcggccacggcccccgccgctatggaggaggcggaagcatcgtacggggagaacatgctcgagtcggaggccatggggaggaataccagggagacgacgccctgcagcttgattaactctgagatgatcagcactcccggatccacaacaagatccagccactcttcccaccgcagggtgaaagctcctcctgtgcactctttcccaagttcaacggagatgaacgagtacttcgctgctgaacagcgacgccaacaacaggctttcattgacaagtacaactntgatcctgtaaatgactgccctctcccaggcaggtttgaatgggtgaagctagactgatagattcagaggacatgagagcagcagcatggaactcacc

SEQ ID NO: 17391 - DNA, 619 bp, Zea mays
  Clone ID: LIB3279-191-Q1-K6-D9
gtaaaaattccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccacttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtagctgactgcggacagctctcctagatctctctgatctggtctgttcggccgccctccctccgtcattgtcgactccccctgcgtccgttc

SEQ ID NO: 17392 - DNA, 114 bp, Zea mays
  Clone ID: LIB3279-191-Q1-K6-E1
gctaaaactgctaattgtctctgtatttggtaattcagctgtagattgctatgatggttgggatttactcgtgaaccagagtttttctatcttatatcctgaattggttatccc

SEQ ID NO: 17393 - DNA, 629 bp, Zea mays
  unsure (1)..(629): unsure at all n locations; Clone ID: LIB3279-191-Q1-K6-E10
cctcccatctcccagnacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgctttatgtcattcctaa

SEQ ID NO: 17394 - DNA, 653 bp, Zea mays
  unsure (1)..(653): unsure at all n locations; Clone ID: LIB3279-191-Q1-K6-E11
gttcaggtcaggccaactctgtcgaanaaggaacatcgaagaaaggaaggaggtgggcggcaatggaggatgcgatggcggcggacgggaagagcgtgctgcaggggcggtacgagctggggcgggtgctggggcacggcaacttcgggcgggtgcacgcggcgcgggacctgcgcacgggccgcagcgtcgcggtcaaggtggtggccaaggacaagctggagcgcgcgggcatggcggagcagatcaagcgggagatcgccgtcatgaagatggtgtcccaccccaacatcgtggagctgcacgaggtgatggccacccgctccaagatctacctcgcgctcgagctcgtccgcggcggggagctcttctcccgcatcgcgcgcgcggggcgggtccgggaggacgtggcgcgctgttacttccggcagctcgtcgccgcggtcgacttctgccacggccgcggggtgttccaccgagacctgaagctcgagaacctgctcctcgacgaggtaggcaacctcaaagtggcggactttgggctcagcgcgctcgccgggcacgcgcgctccgacgggctgctccataccgnctgtggcacgccgtcatacgtcgccccccgagtgctcggcgggaagggctacgaccgcgcc

SEQ ID NO: 17395 - DNA, 638 bp, Zea mays
  Clone ID: LIB3279-191-Q1-K6-E12
ccccgcgtccggccgcttcttcgcccacacgcccgcgcgctcggaatactccgaggagggtgctcgaggagggcgacgatccggccacttcctgctcgcctcgctgccggtcccgcgccccggagccctagagctctccccgcggcgggaccgccggagtcctcgggcgcgcggagagaatggaggcggcgcgcgccaaggacaccaaggagcgtctggccggggtcgagcggctgcacgaggtgcttgacgtcgcggcgcgtcgcgggctgacggcggccgaggtcaccgcgctggtggaccactgcatggatctgacgcgggatgccaacttccgcatcgcccagggcggcctccaggcgctctccgtcgtcgctgtcgtcgccggcgaccacttcaagatccacctcaactccctcgtccccgccgccgtcgagcgcctcggcgacagcaagcagcccgtccgcaacgccgcgcgccagctcctcatcacgctcatggaggaaatgtacaagcacatgggatcacaatttcatgaagcattgcagcgccataatctgccttcatacatgctaaaaaaattcaaggttggataaaatagaaccaaaggttcgatcatctgatacaacaattaggac

SEQ ID NO: 17396 - DNA, 629 bp, Zea mays
  unsure (1)..(629): unsure at all n locations; Clone ID: LIB3279-191-Q1-K6-E2
cgtcggttcattctccagtaaggaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcgaaccagctcatgggattttgctccttccaatgcattccaggtttatgtttcgaaccagtttatgggatcttgctcctattccaatgcatccatggttttgtgaatcttttgctttgggatgctccggcctttgttcggttaaancactttttttng

SEQ ID NO: 17397 - DNA, 568 bp, Zea mays
  Clone ID: LIB3279-191-Q1-K6-E3
tttgtcgcgtgggcggacgcgtgggggcggcgcaaatcaccaacacgtcttctctccggttgcgaggagggtataggatttcgccgcggcgagatgtcggcgtacgacgaggtggagatcgaggacatggagtggaacgcggagctgaaggcgtacacgtacccgtgcccctgcggcgacctcttccagatcacgctcgacgacctccgcatcggggaggagattgcgcgctgcccgtcgtgttctctcttcctcaccgtcgtttacaacgccgaggactttgctgacgccaaggagccgacccacaagccgtccccgagcccagtcgccgtcgcctgatgtggcccgtgcccggcgagatggacgcatggaaatggatctcagagcaggataacgaatgagtttttgtttggcacacaccactacgggagcatttgtactactcttagatgagtcaacccactgcatattttcagagctcaggttgttgaactatcttttttttgtgcttgacattgtaaggtgacatggacagaacatgctatgaaaaaaatgtttagtcactact

SEQ ID NO: 17398 - DNA, 664 bp, Zea mays
  unsure (1)..(664): unsure at all n locations; Clone ID: LIB3279-191-Q1-K6-E4
gttgagnaacttgcaactatacacaatagaatgttcttcgaacctcaagctgcagctcttgctccaactattacttgcctactttgtttttcctatcagtaatgcttgctgactcattgaaacaaaccagtctttcctttgtttggttttacattttgagagcttttcttaaaaacaaccggaggctggattggttatgtgcaaaactattatagaggccggaataaaatttctattttctaagaaaatagaaataaaccaaatacgagtccgagtccgactatgtgcaatgtacaagaatatcttaaaataagggagatactatcctacaagtgtttggttttcattttttcatgtttattatctatatgatcatgactcatatggctcaggtcatgttatctattgtagcgtcttcttgtctccctcgacattgcccgtctgcttccttgcgccttgcttgtgctgtgggctcccttgtctcgcctcttttccagccgtggccaattgtgtccattgctgggtttgccaccaccttcccgtgtcaaggcaaacccctccatttcgagcacgttccaaacccaaacttcacattgccttcttttgagagctacgtaaggatccaaatttgaaactgaccaggtcctagccgtgctgttctgct

SEQ ID NO: 17399 - DNA, 659 bp, Zea mays
  Clone ID: LIB3279-191-Q1-K6-E5
cgtcttcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttgggaagctgttgggcggcgtgaccatttctcacggcggtgtgctccccaatatcaaccctgttctgctgcccaagaagacggcggagaaggcgtccagtggatggagcaaggaggcaaagtcgcccaagaaggccgccaagtcccctaagaaggcatagactgactgtccggagtgatctgatgtttagcagtaccttgttaccagtatgcggtgatgcgttagctgcagatgggacgaatgtgcttgtatgtgtatgtgtcctgctgc

SEQ ID NO: 17400 - DNA, 430 bp, Zea mays
  Clone ID: LIB3279-191-Q1-K6-E6
ctccgccgtcgacttccgtcgcccccctatcccgcgtccgggcttacccgatggcacggctgcactggcttgaggctgtcctgccgctggggatcatcggcggcatgctctgcatcatgggcaacgcccagtatttcatccacaaggccgcgcacggcaggccgaagcacatcgggaacgatatgtgggacgtcgccatggagcgccgcgacaagaagctcgtggaacaatcctccggcaactagggtattgatcaacctcaaacttttctggatgttgacgaacctcgttcaaaagcacagaagtactgctcttttgtttcctgtacaattggaaccaagacttgtttgttttgctttgaaatatcaacagttcggagaataatctgtatctgacatctgtttaattgaacaaagccaaatactttgtc

SEQ ID NO: 17401 - DNA, 431 bp, Zea mays
  Clone ID: LIB3279-191-Q1-K6-E7
tttcgcgccgccgccgcagccgcaacaatgccgtcgcacaagaccttccggatcaagaagaagctggcgaagaagagcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgttatgctaagtaacgaaccctttatcttattatatatgtagtgttgcagtgattgaggtca

SEQ ID NO: 17402 - DNA, 586 bp, Zea mays
  Clone ID: LIB3279-191-Q1-K6-E8
ggaagaaaaaagaggcgggactctgccacaactaggccagataaatataggtttgaaggtactattgcaggatttgaaaaactaagcaagggaaccgagccaacaaaatctttatatcttgaagaacgaactgtgggaagatgaaaaggataagataggcaactttgactcctcatccaacacctacaaggttaaagaatatacgatcaaacatgttttgccctccactggtatggctgctcatgctttagacgatctgtttgaagctgttgaactggaggatagacatgacacatcaatagaaaatgatgctgatgacgaaactaggtcacctgttatgcccccacaaccaccaacggtggttaatacttacgagcaatatgatgctgatgatgaggaagtaaacgttgaataagtagaatgccgagatggtactggaatgagctatatagctctctcgcctgtgtaaagcattatgaaatatgtatttgatgctggagtttaccttgcatacaaaagaatcggattaatgatccttggtggatgcgggttaagcactctgtatcgccagcagcagcacctgcag

SEQ ID NO: 17403 - DNA, 632 bp, Zea mays
  unsure (1)..(632): unsure at all n locations; Clone ID: LIB3279-191-Q1-K6-E9
ggtaaaaaaaggtaagatgcaacagatgtggaggtgcactcgctaaccacgcggttctaccatactcctaatacagtgctggctatcattttccgcatggttggatcgaaaattatctacttaccctttcctaccctcaagtacatcaagagtgcaaagctactattaaccttttgtttctatggaaaggactaactttcaactgaatacgctaactggttgctctgatcaaatctgaaagtcatgttccttcatctgtatcagtacagtttgttgttaattgtttctaaacctgtagtgtggcaacagacatttagactgtgctagaagaaacccagctgaaatttgaggaggaaagacaaaatttgctaaaagtactacctaacaattccaaagagctgtgtgagaatttgtaattctgaagttgagtgtttggagagtttgtgagggctgtggaatgtcgaaggtgaagaacaataatggttatcatggagtcactgagccaatctcgctgagtgggccgactgagaagtaccttatgcagacagttgaggttgaaaagtacctttcagatgcacgactctatgagaggcaagatgaggctaatttgcgagaaagagttntaggcaagc

SEQ ID NO: 17404 - DNA, 599 bp, Zea mays
  unsure (1)..(599): unsure at all n locations; Clone ID: LIB3279-191-Q1-K6-F1
gtcgaccaccacagnacacctgatctacaagcttggaggcattgacaagcgtgtgatcgagaggtttgagaaggaggctgctgaaatgaacaagcggtccttcaagtacgcatgggtgctcgacaagctcaaggctgagcgtgagagaggtatcaccattgatatcgctctgtggaagtttgagaccaccaagtactactgcacggtcattgatgcccctggacaccgtgacttcatcaagaacatgatcactggtacctcccaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactccgaaatactccaaggcacgttatgatgagattgtgaaggaagtctcatcctacctcaagaaagttgggtacaaccctgataagattgccttcgttcccatttctggttttgagggcgacaacatgattgagaggtccaccaaccttgactggttcaaaggcccaaccctgcttgaggctc

SEQ ID NO: 17405 - DNA, 524 bp, Zea mays
  Clone ID: LIB3279-191-Q1-K6-F10
ctttggctaccacgaaagtttgtgtttcacatgagaagtttttgagtgaaaaaccttctctgaattcggctggctgctgtagtcggatcaaactgttgcatcttacttgttcttgttcatacagggagtgaacagaatgcatcgctgttcagtatatcgaacgcaggattccaaagtttggacatttcaatgcttgtaataaccagtggcagatcttaaaaaggaggccatgtctcctccccagttttaaaacacacatctttgtcaagctccgccactgcctataactgttaaatacatctcaataatcaacattggccatgagacttgacaaattgagattcttctgtctgccaggtatgtgccataagacagatgatacagagagactgattgttatattagtaaactgtgtaatttcgagggacaacactatattttgttgcaactcaactcttaaatttgacacatgtatgtgacaaattagaaaatgtgatggatggttgatcaagaaacattatttt

SEQ ID NO: 17406 - DNA, 619 bp, Zea mays
  unsure (1)..(619): unsure at all n locations; Clone ID: LIB3279-191-Q1-K6-F11
ttttctcccatctcccagnacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacggcggcgtgttgcccaacatcaacccggtcctgctgcccaagaagacggcggagaaggcgtccagcggcgggagcaaggaggccaagtcgcccaagaaggccgccaagtcccccaagaaggcatagggtttggaggcggatccgatgttgtcatgtgtaggttgtaagcgggcaatgtgattggctgtgtatctgcttcgctcaagttgcttt

SEQ ID NO: 17407 - DNA, 235 bp, Zea mays
  unsure (1)..(235): unsure at all n locations; Clone ID: LIB3279-191-Q1-K6-F12
cgtccttttttcgcgtgggnttcttaaaccgagcaccagggtagcagacgcggnntctctggaacccaggttccagcgaggcaaaccatctaaccaggncgctgagaatnctgtnncngagggaggcggatggcaatgggggcngnngcnngagggagcgggcncagggactcctaggcgganctcaacctgccgccagggttccggttccacccaacggatgaggagctcgtgg

SEQ ID NO: 17408 - DNA, 569 bp, Zea mays
  unsure (1)..(569): unsure at all n locations; Clone ID: LIB3279-191-Q1-K6-F2
cggttcgacccagcgtncttttttaccaaaaaacagcgacctctaacgcttagctagctctttgtgtcagcgcctgagcatcgagctattggcatggcgcactccaccaccttggccctggtgattgtcgttgtgctggcgctcacctttggtgccacggtcagtgtctccttttccgtgaacaagtcgtgcgtcagcggtagcgccggcgccagcgtgagcattggctacggcggggcaagagccagcgccggcgctggcgtgtcccttggcgccgacgcgtaccggagcacgtgcccccgtgccgaggagatcatccgtgcggccgttgagagggccgtcgctgccgacccacgcatggcagcgtctctcctgcgcctccatttccatgactgcttngtcaacggctgtgacggctccgttcttctggacgacaagccgttcttcatcggcgagaagacggttgtgcccaacgcccactcaatcaggggcttcgaggtcattgacgccttcaagaccgagctggagcggtagtgcccagttccagttttctgtgccgaccttcttgc

SEQ ID NO: 17409 - DNA, 586 bp, Zea mays
  unsure (1)..(586): unsure at all n locations; Clone ID: LIB3279-191-Q1-K6-F3
ttccgaccgcctcctcctcctcgttctactcgccgccccttctagaatcatccagaggcgtgccggtgaagcgcgagagcggtgaggcatggcgatgcagacgggggtcgcgacctccaaggtcctcatcctcgtcggtgcagggatgacgggctcgatcctgctgcggaatggccgcttatctgatgtgttgggagaactccaggagattatgaagggtgtaaatcaaggaacttcttcgggtccctatgacattgcacttattcaagctcagattcggaatttagcccaagaagtcagagatttgacattgtcaaagcccattaccatactgaatggcaaatttgactcgggaggcagtttatcatcctacatactgccagcagcagcagttggagcaatgggttattgctacatgtggtggaaggggttgtctctctcagatgtcatgtttgtcacaaaacacaacatggcaaatgctgttcagagcatgtcaaagcagttggagcaagtttcatcagcactagctgcaacaaaaagacatctaactcaacggcttgagaatttggatggcanaatggatgaa

SEQ ID NO: 17410 - DNA, 558 bp, Zea mays
  Clone ID: LIB3279-191-Q1-K6-F4
cgcctgccaacctgaaagccttggactctccggcatgactgagccgccgggcggggagcagagagctgaggaggagaagctgcagaagcgcgtcactccaggaccagggggacatgacgggcccggagtggaagtctggcacgcatatcgacttcgagtcaagcaggcggcgaatacctcaacagattgctggtcggcaacatctacaccttcgaccacacagaggatccccgtggtccgatgagattacaacgacctgcaagacagatggtggaatgtgcgtcgataaacatcctatctgcaagatgctgctcggtatcgacttccccatccaagtctatggcaccgtgtgcaggactgcatcgactacaagtgtgttcctcttccgcgagataatgaccattgccaactatcagctctaatgaagaatattgatcttgatggcccaaaacgggacttgcattgggtacggtgctgattatgttcagactgatctctgggtcaaggatcgcaaggcattgcaaacaattagtaaggggatcgtgaggatcccagcac

SEQ ID NO: 17411 - DNA, 554 bp, Zea mays
  Clone ID: LIB3279-191-Q1-K6-F5
gtttgctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttctcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcggctacggcggtcggcgcgagggtggtggcggcggctactgaggcggtggcggctaccggggtcggcgcgagggtggtggtggcggctaccgcggcggcggcggcggctggagggactgatgtgtg

SEQ ID NO: 17412 - DNA, 594 bp, Zea mays
  unsure (1)..(594): unsure at all n locations; Clone ID: LIB3279-191-Q1-K6-F6
ggtatgccccctggncttgaagaagcgcttgtactatcaaaggtgataaaatctattgacgtgcaagaggccgatatacttcggcgtttagtgctggatgctccatccactggacatacacttaagcttctgtcagcttctgattggattgaaatgttccttactttgagcattaagggcataaaagtggcttcgtccatgccatcgtttaatatgtatcttgaggacgtgcaattcatctctgccaggctagaggaactaaggcagcaggttcgcagagtgcgtgagattttgtttgatccacaatcaacagaattcatcgtcgtgacaattccaacgatgatggcagttactgagtcatcaaggtttcacgagtctttaaagaaggatggtgcacacacaagaatgctcgtcataaatcaggtgttgccaccgtctgcgtcggactgcagattctgtgctgcaaaacggngggaagaagcacgtgccttccgtgcgattctggaggaccgagaactcggcggcctgaagctgatccaggctcccctccttgatatggaggtgaaaggcgtccctgctctccggttcctcagc

SEQ ID NO: 17413 - DNA, 693 bp, Zea mays
  unsure (1)..(693): unsure at all n locations; Clone ID: LIB3279-191-Q1-K6-F7
ccgggtcgnacccaacgcgtccgtttcatggcaccacaaggcaaaanaagctcaggtngagaatgttgtgatggtnntgatccactggaagctaagcgcctagctgctaaacaaatgcaagaaattagggccaaagaaaagctgaaggtgcattgttgctgtattggagtgtttcattccttagactaaatcaaataatcaatcatatatactaatagatggaaccttggtaataaggaaaagtggaaaacttataccttttgtttgggccaattgttggtgctgaatcgttgtttcagaaaactggaaacagaactaggcttttccctgttcatgctgtcctgcaatatgagaacaagaaacaccattgtagtatttgtttggtcgtaatttttgtgttccggagctatatcagaacggntcctaggtgtcaaatgcaccctaaattaaaaaaaaaaatctacctgtggggaaattgtagctcataaaagagatgctgaaattcatttagtgaaacatatatgtttattttattatttcgctaatatatggtctccactttctgttaacaaatagtcatttaatcatccattaattggtgtctgtttgtcctcctggagacatcatctgctgcactcccctctgaatcccatatcagtctatattctattttgatgcttcattgngtttttc

SEQ ID NO: 17414 - DNA, 632 bp, Zea mays
  unsure (1)..(632): unsure at all n locations; Clone ID: LIB3279-191-Q1-K6-F8
agcgtccgtttatgaaaatgtgttcttggagatgagagcattagcaacaattgtgatgaaaataataaagatgccataaaaactggaagcgtaagtgagagacatgaagagctgataattgaagaagaaaatgagaaattgcagcaggcatttattgaagatgccaattcccaagcggggagtggttcatcaattaatgagcggacgaattctgggttttctcgcggctcatcagaggctgggttagatgaagatcagtcctcaaccggtaagagtggggactcatcattttttgctggtttcttgaagaagggtttcaaggacctttctttattaaataagtccatggacagcgttaaggtttcaattaatggtcatccaatctctgaaagagcccttaagaaggcagagaagaaagctggtcctgttgacccaggttcatattggtacgactaccgtgctggtttttggggtgtcatgggacgagaatgtatcggcattgtccctccatttattagagaatttaattatccgatggccagaaattgtgccggtggggattctggtgtttttgtcaatggcagagaactgcctcaaagagattagatctacttgtnggaaagagactacca

SEQ ID NO: 17415 - DNA, 608 bp, Zea mays
  Clone ID: LIB3279-191-Q1-K6-F9
tccgtttcgattcccaatccagcaaaccctaccagccttttgcaaactcagagagggacccgatggcacccaaggcggagaagaagccggcggcgaagaagcccgcagaggaggagcccgcggccccggcggagaaggcccccgctgggaagaagccgaaggcggagaagcggctcccggcgggaaaatccgccggcaaggaaggcggtgttgacaagaaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctcctttcgagtaggtccttaagcgccgtggcgccttttgactgtatggaatgtttgtcatctgaaagttgatctgagcagtgcaa

SEQ ID NO: 17416 - DNA, 293 bp, Zea mays
  unsure (1)..(293): unsure at all n locations; Clone ID: LIB3279-191-Q1-K6-G1
cgtccggttctctaccacaggcacactgnaccggctgnccggcttgggnatactganagactgcatgtcttttntccgtgccgcgcgctgngaattcgcacggccctaccacgagcacgtgccgtacggggcgtcagcgcgtgctggatcgaagagggatgcgagctgagagagcgcgcctgatgagaggctgagacgagacctgatgcggcccacacctgcacgtgtccgtataatctgttcagagtgttcgtaatcgatcttttcaaatttttctcaatgctgttttccgc

SEQ ID NO: 17417 - DNA, 421 bp, Zea mays
  Clone ID: LIB3279-191-Q1-K6-G10
ctgcccctttggtgggcttgggagtgttccaccaggtggtcgctatgatccaattggcccacctgacgtcccagggtttgagccatctagctttgttaggcgtccaaggcggcctccaggcgggagcacccacccagacctcgagttcttccagcaaggcccagacttctgagaatcgcgcagaggccggccagagcctcgccctaccctcacgaaataacttcaaaatgctgagccctcgagctagatatcccgctcgcttggtgtgattgcaactgctgtatcgagtatagtcctagtgcgctttggctgtaaagatggatgtgaacatcgtcctagtgtatttactcttaattccaaaccatcgtctgtcgtagcctaatatactcttttgtgtataatatcgggtgtaccggagctg

SEQ ID NO: 17418 - DNA, 629 bp, Zea mays
  unsure (1)..(629): unsure at all n locations; Clone ID: LIB3279-191-Q1-K6-G11
gctaggnagggactaggagagagagangggggaaggccaagaagaggcttcctctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccaacaagctcaacagttccaccaacagctccagcagcagcaacagcagcagcttcagcagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcg

SEQ ID NO: 17419 - DNA, 294 bp, Zea mays
  unsure (1)..(294): unsure at all n locations; Clone ID: LIB3279-191-Q1-K6-G12
ttttgttaattgcctgtccaaggtgtctcgggatctgtggtactagttntggactgccttcctgtgtntcgtattgtagcagttgtggtagctggttgctttgtcgtcctgtagtcgtgcttctttgggtctgtaagaaccgctggttcgatgggattggattgtacggtgaagtaggaatgttggcatgttagacttttctccaacgtagcgttgcctctaatttgatctctcaatttattttcaattggggtgcactgtaattcttcctgtctaattcaaatcccctttctg

SEQ ID NO: 17420 - DNA, 589 bp, Zea mays
  Clone ID: LIB3279-191-Q1-K6-G2
gctatgtaaaccttgatatgtgttaattcttgttgtttttcctcttgttgtatttggtatacattcatctgaacaatttcccgtttctcctactcgctgccctcttccttgtttattcctctaatgtgttgctgccttgctgggtaacaagtgagtgcggccccatgtattttctcaccaatttgatgaattcgtacagaacttactttagtacagtaatctgttggaagggagttcctgtcttccatcaaatattctgctttttaccagggtacctggtttcatgtacccatggatgttttgtttctttcaaactttaatagcttcatataattcccaaaaaacaagttttctagcggtatctattaaataacatttctttgtgaggcgtattgctgcatgcttgtttattaagtttgctactcatgttcaaaaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtcct

SEQ ID NO: 17421 - DNA, 656 bp, Zea mays
  Clone ID: LIB3279-191-Q1-K6-G3
gtgacaggttgcttattctaagttctgggcaggttctggaattcgactctcctgagaatcttctaagcaacgaggggagtgctttctccaagatggtgcaaagtacaggacctagcaacgcagaatacctcaagagtcttgtatttgcaagtggagaagagaggtcccggagggaagaaatcaagctgcaagatatccaaaggagatgggttgcatctaaccgatgggctgaagctgcccagtttgcgcttgctagaagcctcacatcatcacatagtgacctccttgcattagaagctgccgagggaaataatattctgaggagaacaaaggatgctgtaatcactctgcaaagcgtactggaagggaagcacaatactgaaatcgatgaatctctaactcagtatcaggtcccagctgatcgatggtggtcttcactttacaaagtgatcgaaggcctcgccacaatgagcagattgggccgcaaccgtctgcagcaaccttcttataattttgagaacaacaattctattgactgggaccaaatgtagatgtagaattctggatcacaacagcattgtggagtaggctggatgtgtagttatttctggcggatttgattcctgcggtgtgtaaacgctgcagcaacacgtaac

SEQ ID NO: 17422 - DNA, 337 bp, Zea mays
  Clone ID: LIB3279-191-Q1-K6-G5
gtcgacgactgggccgccgccgcctccgtcctacgctcggtgctgaggccttcgggacttccgccggcgacgcgcaccctccgggttgaaatccctcgagaacaatggggcgcacggttctttcagatgaagaagaagatgagttcgaggctgacgaggaggatccgcggccctcgcggaggaacagggacgatatggacgagcgcgatgacgacgacgacgacgatgaggacggtcaggatgaatttgagaaggatgacttcatagtggacgacgaggaagaagaagaagtggaaggagaggaagaggaacagaagagtgatgacgagaggcgaag

SEQ ID NO: 17423 - DNA, 627 bp, Zea mays
  Clone ID: LIB3279-191-Q1-K6-G6
tcgtgacctcccaaacctagacctagttgtccttcctgttcaacctgcatagcggcggcgcgtcctgccttcagagagagagggagagagagcgcttgatctccgtaggcatggcatgggaggaggaggcggtagaagaggaggattacggggaggagatgtcggcttcggagtcggaggaggacgtcgtggtggggcagatgccgacggttatggtgccaaagcatatcaataagcgatccctgaagaacaaggcgctgtctgttaccctcgacaagaaagcgctcagggatttcgtgactgggttccacaagcggaagaaaaagagaagaaaggaggcgcagaagattttgcaggagaaggagaggaagaagaaaatacaagaccgcaagaggaggaaagaagagaaggagattgctctgtatggtagagtactgacatcggataaaaatgatggtgctggattagaaaacgaagatatcggcgatgatggtgaggatatggaaaatgacaaacctttgtctgaaatcaaaacctacgaagatgatgggaccagaactgtagtcaccaccagtgaaattactccctgaagaagagacattgtcccgaaaactgtcgggcccgtgg

SEQ ID NO: 17424 - DNA, 648 bp, Zea mays
  Clone ID: LIB3279-191-Q1-K6-G7
gtaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacatcaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagaggtggtgatct

SEQ ID NO: 17425 - DNA, 235 bp, Zea mays
  Clone ID: LIB3279-191-Q1-K6-G8
gcgtccgggttggtggagttgtggtgtgtgtgaagtactggctgtttgtgctggatattgcactgcctgtggccataccatagcatgcattgagttttctggcaaacccattgaattccccaattgtggtctagcgaggaagtgcctttgcttggtaacttgttcgcgccatacttctggggctgtatcatcgccaaaccatgcgacgcttacttatttcatttggttctctgca

SEQ ID NO: 17426 - DNA, 631 bp, Zea mays
  Clone ID: LIB3279-191-Q1-K6-G9
cttagttgtaccacttgtatgttgcttcattcaaaacttgttattatgttgacttgtgaccgaactttgatttatgcactgaacacctaacctatatctagcttatgtacccttttttagatgtagttctaggcaatggatacttttcaaacttgactatggatgacaatagtcaaggggatgttcatgctaataagcaacacatgtcctgatattcagtctcagtcaatgcaagctggagcaacagcccccacgacgaggccaaatcataagagataaaaaaaaatcagtggtcaggatgatgaagtttaggtgttagcttggttatatattagtttagatcatgtggttggcaaatataaaaaagtaggaaggtattggtctcgtatctacgagtacttaaatgaacataaaccatgtcaatcacagcgtacctttaattctcttatgcaccgatgggagacaattcagaaatgtgttaacaagttttgtggttgtttatcaaggattgagttaagacgacagagtggtagtacaatgcaagacatggttgcacaggcatgttcgttgtgcaaaactctggacaggttgcaaaactctggacaggatgcaaaatcactatttgctgtca

SEQ ID NO: 17427 - DNA, 148 bp, Zea mays
  Clone ID: LIB3279-191-Q1-K6-H1
gggtatttgggggcgttttgccatcccactgccaccgcatctgtatctttcacacacttgccgagttccagggaagggttatgctggtgggtctgctgtgcaaaattgctttgtcctgtgtttgcctttgggagttgctgaagatgac

SEQ ID NO: 17428 - DNA, 497 bp, Zea mays
  unsure (1)..(497): unsure at all n locations; Clone ID: LIB3279-191-Q1-K6-H10
ccccgcgtccgccccgcgtccgcccacgcgtccgggaagctgcagaaaaggttaactttatctctggggctaagcttcaattcgacattcgcccattcttcagtattaatgtcgttgccgccgagtacaatagtgattccccggtgcatccacaccaaggatttcatcaccaccagccccatcaacgattacaatggtgaagagtttgtcttctactctacaaggaagtaccgtgccaaaaaactcaataatagagtatcacagcaaccaaaatggctaattgttgccactagagagaatgtatagcctattatgtctggcacttagtgaatcgatagctttaagggcaagttatgcactcgagtgactacaatagggaagggaggccttccaaggcaagaaagtgctcgttgtcggttgtgataacacctttccaaaaataatgttcatgcctaanaaaaaaaaaaaaaaaaaaaaaaaaaaaaaaaaaaanaaaa

SEQ ID NO: 17429 - DNA, 437 bp, Zea mays
  Clone ID: LIB3279-191-Q1-K6-H11
gtagcagcttcgcgaggggaagaatcgaagatgatcgaggtgacactgttcaagctgttcctgacattgggccaactgtcaaatcagctgccaccgcacaaatggacgctgcagtgatcgcactgtcacgagagctgagcaaactacggactggaagagctacacctggcatgcttgaccatatcatggtggagaatgcagatgttaaagttgcattgaatcgcattgccgctgtttctgtcctggacgcacataccctatcagtgatgccttatgatcctacttccatgaagacgatcgagcatgctattatctcatcaccattgggcattaatccaacacctgatgggaataggattattgcagctatccctccgttgacaaaggagaacatacaggcactggtcaaggttgttactaaactagcgggaggattt

SEQ ID NO: 17430 - DNA, 258 bp, Zea mays
  Clone ID: LIB3279-191-Q1-K6-H2
ccactctccgcttcccgctccgatcgacctgctccctccccaccatcgagcccatggcggaccagctcaccgacgaccagatcgccgagttcaaggaggccttcagcctcttcgacatggacggggctggttgcatcacgaccaaggagctgggcactgtcatgcgctcgctggggcagagtcctacagaggctgtgctccaggacatgttcaacgcggccgttgctgatggctccggccccctcgtttccccagtgt

SEQ ID NO: 17431 - DNA, 609 bp, Zea mays
  Clone ID: LIB3279-191-Q1-K6-H3
ggctgtggacgccgccgcaccttgctctcccgggctgcgaactgcgactgcgacggaccagccgatgcagccgtcttcctgaattgttgacgagttctcagatccaggtcctgggggtccgggccgtggaccactattccgcctctgtctcccaggcagatgaagcctcggcacgagcgcagcaggtccaccacgtccacgttcgtctcccaggtccagcaggatcaggacggtggcgacgccaacggcagcgcgacggaccaggaggtgatggcgcagccggaaaatggcgtctggtcgccgctgccgccgacggacatggaggagtcgccgcgggtgagcgacggaagcgccaccaaggagcgtgtgcggctcctggagcgggaggtggcgtcggcgaagcagacggagatgaagatgctggagtcgctggtccagcagaccaaggagctggagcagaccaagatcgcgctcgaggaggcctcgctcgaggtcgccacgctgcgtcagcagcagcagcagcagcagcagggcaagggcggcgccgctgctgagccggccgcgcaggcgcagcagtggagcgtcatggacctcatgttcggcggcgtc

SEQ ID NO: 17432 - DNA, 664 bp, Zea mays
  Clone ID: LIB3279-191-Q1-K6-H4
gccatatcgaactataatgaatggcttgcatcatctggatgtagcgtcccctgtcagcgatcaaggcatgcgtccacaagtggggcagtctgccggacctcctggttggtatgttcctaggggtagtgtatcaaatggtcaaccaccagcttatgcatcatcaggatcaggtcattatcagtatgaaagttcggggcattcacaatatgaacaaggtaaccatggaaggcaacaatctcacccatatgcaagagatggcttccatgatacacgaggaagggttccacctgcatatgggtaccagcagagcaacatgtatccatcgggtcctggattgtatgggcaacctccatcagcatatcctggggttcatggtggaggctaccaaccccctccatatggcggaggccagcagtggcagcaacaatcatatagttcgtatgccgtgcgaggcccctacggaggcaggccaccacccacaagggctgattcagggtcacagcaaccacagaaccgttatggtgctttagacagaagtaacaaccggaggccttcatctggatacagaagataatagtttgtgacccagtttatgttatagctcaaagtttgttatcagtagagctttgagtaactcagctaaaagcatagcggaatagtctgc

SEQ ID NO: 17433 - DNA, 521 bp, Zea mays
  unsure (1)..(521): unsure at all n locations; Clone ID: LIB3279-191-Q1-K6-H5
cggacgcgtgggcgcgcagcgccgccgccgtgctccgcgtcttcttccacgactgcttcgtcaatggctgcgacgcgtcgctgctgctggacgacacgcccacgacgcccggcgagaagggcgccggccccaacgccggcggctccaccgtcggcttcgacctcatcgacaccatcaaggcgcaggtcgaggccgcctgccccgccaccgtctcctgcgccgacatcctggcgctcaccgcgcgcgacggcgtcaacctgctcggcggcccgagctgggcagtgccgctgggccggcgcgacgcgacgttccccaacagcacgggcgcggcgacggacctcccgggcccggactccgacctggccggcctggtggccgggttcgccgccaagggcctgggcccgcgcgacctcgcggcgctgtcgggcgcgcacacggggggggaatggggcgctgngccngcttccgcacncgcgtgtactgcgacgacaacgtgagcccggcgttcgtcgcgcagcagc

SEQ ID NO: 17434 - DNA, 651 bp, Zea mays
  unsure (1)..(651): unsure at all n locations; Clone ID: LIB3279-191-Q1-K6-H6
gcctcgcccgactccgcttcccctgttctttgggcatggagctgatcacaaatgtcaccgagtacgagaagctcgcgaaggagaggctgccgaagatggtgtacgactactacgcctccggcgcagaagatcagtggacgctcaaggagaaccgggaggccttctccagaattctgtttaggccacgggtactgatcgacgtctcccgtatcgacatggccacaaacattctgggcttcagcatttccatgcctatcatgatcgctccttcagccatgcagaaaatggctcatcctgatggagagcttgccacggcaagagctgcagcttccgcaggaacaataatgacattgtcctcatggtctacttccagctttgaagaggtcaactcagttgggccgggcatacgtttcttccagctctatgtctacaaggacaggaatatcgtacggcaactcgtgaaaagggctgagatggctggcttcaaggccattgcactcacggtagacactccaatacttggccgcagggaagctgacattaagaacaggttcgccttacctccacatctggtgttgaaaaacttccaagcgctggatcttggcacgatggacaagacaaatgattccggccttgcttnctacgttgctg

SEQ ID NO: 17435 - DNA, 622 bp, Zea mays
  unsure (1)..(622): unsure at all n locations; Clone ID: LIB3279-191-Q1-K6-H7
tcgccggcggcacagcgcagcgcagcgcttccactgttgggtgtggtggatttcctccgcccccgaacgatcgatcttttgcatggcagcagcggctagctccaagggcgggcgatcgctgggagcttcgtcagccgcgtcctggccggcaaggccgcctccccgaggagggccgtgcacgcctcgtcgtacgacaagaacccggaggagcaggtgcgcccggcgttcgtgccggacgatgtgatcggcggcgcggggagccccgacaagtactggagcccccaccccaagaccggcgtgttcggcccggcggcggtggacaccaaccagctgggcgtcgccgctgacgctgccgccgcgaatgcggctgcagcaggatgttcggtgctggaccagaaggtgtggttccgcccgctcgaggacgtcgagaagccgccccccgtcgcctgaaccgcgccacgcccacgcgacgcgacgctgccagcccacactgctgatacaagggcggcggccgggagggagagtcctggcaacgtcatgctcgtgcctgtaataagaacaagcaggagatgtgtgtgcctgtgatgtaccggtgtcgntatcagcgttatacaagtacttg

SEQ ID NO: 17436 - DNA, 574 bp, Zea mays
  Clone ID: LIB3279-191-Q1-K6-H9
agcgagcaaggtgataggtaccgtgaattggcccatagggtggatgaggctcttgggttcatgaccgcagcagggcttacagttgaccacccgataatgacgactactgacttctggacctcgcacgagtgccttctcttaccctacgagcagtctcttacccgtaaagactccaccagtggccttttctacgattgttcggcccacatgttgtgggttggtgagcgcactcgtcaactcgatggagcgcatgttgaattccttcgtggtgttgccaatcctcttggcataaaggtgagcgacaaaatgaaccccagtgacttggtgaagctgattgagattctgaacccttcaaacaaacctggaaggatcaccataattacaaggatgggggcagagaacatgagagtgaagttgcctcatcttatccgtgctgttcgcaatgctggattaattgtcacatggattactgatcctatgcatggaaacaccatcaaggccccttgtggcctgaagactcgtccatttgactcaattctggctgaagtgcgcgcattcttcgatgtgcatgatc

SEQ ID NO: 17437 - DNA, 588 bp, Zea mays
  Clone ID: LIB3279-222-B6.F3A
cctgcaaagttatggaggcagagaaggagaaaaacaaggctttaatgaacgcgcagctccgggagcagcaaaatggagcatcaacaagctccccatcactttcaccaccaatagttccagattccatgccaactctaaatatagggccatgtcaacatagaggggcagcagaatctgagtctgaaccgtctcctgctcctgcacaagcaaacaggggcaacctgccaccatggatgctccgcactgtcaagtaacaggtgaggtcttcccagtgtagttttgcagctgatctcgacagcaacacacctgtcaccgaaatgcttcggtgaccttagatatcaaccgatgcacgatccatctcgatcctgtgatcgaataccggcgtaggtactactaataaagtcaggccccgtcaaatgctttacatggtgattgaagtctggagcttctcagcaccaccatatattgtgttcagttcttgtgtttattgccatagctaccctttttttctctgatctacgagctagacgtagctttgtgcttggagattccactactatgtttcctctgtcctgtgtatgctttaac

SEQ ID NO: 17438 - DNA, 605 bp, Zea mays
  Clone ID: LIB3279-222-B6.R3A
cctgtttgcttgtgcaggagcaggagacggttcagactcagattctgctgcccctctatgttgacatggccctatatttagagttggcatggaatctggaactattggtggtgaaagtgatggggagcttgttgatgctccattttgctgctcccggagctgcgcgttcattaaagccttgtttttctccttctctgcctccatgaacttttgcaggacaccgttttgatctgtaagtgctttctcctttttctgaagcgcggaaattgaatcgaacatgagctgattctttcttgacctaatatgcttcaaagaactgtccagttgttgctccagttgctggagttcttttatggttagtgaactcaattgttctcctaacagctgcctttgactcttctgaagtgcatcaagtttggattttaaccggacatattcatctccccaatttgcctggtcttcaatacttgggttaagtactgccctttcttcaaatgagtaacgctggtaacgctcaagaatgccttccatgctggaatggctagagtactcgtagagcttccccttagtggagaagacgatgagcgcgacctctgcgtcgcaga

SEQ ID NO: 17439 - DNA, 423 bp, Zea mays
  Clone ID: LIB3279-057-D9-F3A
ggtcacttggagcacatcggtgcgccttctcgaaggaggaggaggagcggctcctggcggcgcaccgtgcgtacgggggcaagtggtctctcatcgcgcgcctcttcccggtccgcaccgacaacgccgacaagaaccactggcacgtcctcatggcgcgcaggcagtgggagcactcgggcgcgctccgccgacgcaagccctaatcgacctcgccctcgtcggtgccggtgccgacgccagaccagacgcacctgcgtgttctgcaccactaccaccactacgccggcgggttcccttccatgccgccgaagcacgtcgtcgacccccacacgcatttcaatgcagcggctgcggtagcgtacacccgcgcgcacagcgggggcgagtacgaccagaccgccttcacgtgcaccaccgacc

SEQ ID NO: 17440 - DNA, 574 bp, Zea mays
  unsure (1)..(574): unsure at all n locations; Clone ID: LIB3279-057-D9-R3A
ggaagtcgaagaagggcagcgagaccttgtcgtcggagcgcgccgtcgccggcggcgcggagaaggcggagcgcgcgctcggggcgaacgtcgcggcgcgcggggccacgtcgtagccactctggtagaagcagggggcggcggaagcgagggagaggtcggtggtgcacgtggaggcggtctcgtcggactcgccgccgctgtgcgcgcgggtgtccgctgccgccgccgctgccgtgtactgcgtgtgggcgtcggcggcgtgcaacggcggcatgggaggggagccgccggcgtagtggtggtggtggtggaggacgacgacgggcgccaggtgcggcgccggcgccggcgccggcgagggcgaggtcgaggagggcttgcggcggcggagcgcgcccgagtgctcccgctgcctgcgcgccatgaggacgtgccagtggttcttgacggcgttgtcggtgcggcccgggaagaggcgcgcgatgagagcccacttgttgccgtacgcgcggtgcgccgtcaggagccgntcctccttcttctccgagaaggcgccgccgttgatccgcgg

SEQ ID NO: 17441 - DNA, 522 bp, Zea mays
  Clone ID: LIB3279-222-B6.F2A
acaacgcaaatttatatatattaccacgggtacaacgtgcatctccgttaaagcatacacaggacagaggaaacatagtagtggttttttcaagcacaaagctacgtctagctcgtagatcagagaaaaaaaggtagctatggcaataaacacaagaactgaacacaatatatggtggtgctgagaagctccagacttcaatcaccatgtaaagcatttgacggggcctgactttattagtagtacctacgccggtattcgatcacaggatcgagatggatcgtgcatcggttgatatctaaggtcaccgaagcatttcggtgacaggtgtgttgctgtcgagatcagctgcaaaactacactgggaagacctcacctgttacttgacagtgcggagcatccatggtggcaggttgcccctgtttgcttgtgcaggagcaggagacggttcagactcagattctgctgcccctctatgttgacatggccctatatttagagttggcatggaatctggaacta

SEQ ID NO: 17442 - DNA, 406 bp, Zea mays
  Clone ID: LIB3279-057-D9-F4A
ccttttttttttttttttttgggattttttttttttttttttttttttttttttggacaaggaaaataaaataatacttttttattaaaaataaaattggttccctgatgattgggtcggggacatacaaatttatttccaacaaattccccctcccaaatgatttatattgaaccaggggactttccactttttattttcaatactaatataaaaactggccccggttgcctgaaacctgggttttaacaaaggttatataaaaagggttacaacacatttttttatacacttttttcaaaacattttttttattggtggaaaatttttagaaatcacaaaaatataggggcgcctaaatcttattttaaagagttgggaatttttattatttggaacatatggg

SEQ ID NO: 17443 - DNA, 500 bp, Zea mays
  Clone ID: LIB3279-185-Q1-K6-A5-F2A
gctcttcggagtatcatttcagtaaaaatatgcgggctggcgcacaaaagcagagggacagacgcagcaaagaagattacaattattctctagcgggctcacatgaccctcacagcggaatcggaatgcacatgaaaattacaaaatatagagctcagtaggagtgattaggcttggcagttcctgtgacatgtccttgggaaaactggtgatgataaacattgcttaaagatcctcagggccattgacatccttgttctcaagtacgtctccatctggaatctccaacttcactccaggcttggcgataattgtcaccttgcccttgagtgtaattccagagccaaaccagacatcaccagaaaccttcaagctgtcaagctcaactatgctggggatggacttgaaccgaccaaggaaattggcaaccttcttgaactcaggtccaagctcaattgaagggttagctggattcgctctggatggttgcggatgacaaa

SEQ ID NO: 17444 - DNA, 721 bp, Zea mays
  Clone ID: LIB3279-185-Q1-K6-A5-R2A
ccacacctcctcgcttccactccgctcgtctgacatctcgtcccgtcctttcgtttcgaagcctcgcgagccccgacgatggccaccgccgcggtgtcggtcgacgagaagctcgacaagcttcgcgccgaggtcgccaagctcgaccagatcagcgagaacgagaagtccgggttcatcagcctcgtgtcacgctacctcagtggggaagcggagcagatcgagtggagcaagatccagacccctacggatgaggtggtggtgccctacgataccgtcgcgtcgcctcccgaagatctcgaggagacgaagaagctgctggataagctcgttgtgctcaagcttaacggagggctcgggacgaccatgggctgcactgggcccaagtctgtcattgaagtccgcaatgggttcacattccttgaccttattgtgattcaaattgagtccctgaacaagaagtatggatgcaatgtccctttacttctgatgaactctttcaacacccatgatgacacacagaagattgttgagaagtattccaactccaacatcgaaattcatactttcaatcagagccagtatcctcgcattgttaccgaggacttcttgccacttcccagcaaagggaaatctgggaaggatggctggtatcctcctgggcatggggatgtgtttccctctttgaataacagcgggaaacttgacatcttattggctc

SEQ ID NO: 17445 - DNA, 530 bp, Zea mays
  Clone ID: LIB3279-057-D9.F5A
cgagcgcgcgctccgtcttctccgcgccgccggcgacggcgcgctccgacgacaaggtctcgctgcccttctttgacttcctcggcgtctgcgcggcgtgatgggggggccggcccgggccggccaggcggcggtgtacaggagggcggaggcggtcaaaggacgagagccccggcggtggtgaacccgtgcccgcgcgtagtttagctttagagcccgagttaaatcatcgagaacagaacatggcctgagcctgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcacgggcgacgatgggtatgggtggatgtttgcagaagaagaaaaaaccgcttgtaacacaaactgcttgacaaaggccgatcaaagatcctcttgtacttcttttttac

SEQ ID NO: 17446 - DNA, 226 bp, Zea mays
  Clone ID: LIB3279-222-B6.F4A
gccccgtaaatgcttacatggtgattgaagtctggagcttctcagcaccaccatatattgtgttcagttcttgtgtttattgccatagctaccctttttttctctgatctacgagctagacgtagctttgtgcttggagattccactactatgtttcctctgtcctgtgtatgctttaacggagatgcacgttgtacccgtggtaatatatataaatttgcgttgt

SEQ ID NO: 17447 - DNA, 220 bp, Zea mays
  unsure (1)..(220): unsure at all n locations; Clone ID: LIB3279-222-B6.R4A
ttagtggagaagacatgagcgcgacctctgcgtcgcagagcacggagatctcgtggngccttcttcagcagcccgttccggcgcttggagaaggtcacctggcggttgatcttgttctcgatccggcgcagctgcaccggcccccgccccatctccgccgcctcgccacctaccctctcccgctcactctcgtcgcagcaatggtgatggggacgtgtgg

SEQ ID NO: 17448 - DNA, 479 bp, Zea mays
  Clone ID: LIB3279-004-P1-K1-F1.F2B
aaacacacatcacatcccttttttgttgggagaccagatggcagcatcatacacagcacaaacccagtaaatcagtaatccatggattcatggagcagtcacagaaaactagctgaagcagtctagcctaaaagatacacatcacatccctttttcgcttgcaaagagtagctaagcaaacaacggctggaaggaagagcaggcaacacgagcattatgtcgtcacaggccatcagggcttcatctcctcgtcatcggcgatcttgggggccaggtaaaatctaatgtaacccatctcagcgatcttgtactcgaccaccactggaagctcggacgacaggctgatagtgacttgctcaaacagtgaaaacgccttggtgaaggagttcatgtaccgcagggcaaaggtcagggaaaccggctcctgcatctctataatggtagcctcttctggcttgcaatagtttggttctgcctgc

SEQ ID NO: 17449 - DNA, 588 bp, Zea mays
  unsure (1)..(588): unsure at all n locations; Clone ID: LIB3279-004-P1-K1-F1.R2B
tgaggatctgcaaagatcttagcagcatcggagacacagtcgtcatctcggtgactaaggagggcgtgaaattctccacatctggagaaattgggagtgcaaacattgtctgcaggcagaaccaaactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgacgaggagatgaagccctgatggcctgtgacgacataatgctcgtgttgcctgctcttccttccagccgttgtttgcttagctactctttgcaagcgaagaagggatgtgatgtgtatctcttaggctagactgcttcagctagttntctgtgactgctccatgaatccatggattactgatttactgggtttgcgctgtgtatgatgctgccatctggtctccaacaaagagggatgtgatgtgtgtc

SEQ ID NO: 17450 - DNA, 403 bp, Zea mays
  Clone ID: LIB3279-005-P1-K1-B8.F2B
ggaacagcaaatggccaaagattcatcattagggcattaaaatgctgaaattgcccatcaaattacacaaccttaatagcagccaaaccggcaaccgtttcatcccatatcattagcaaccaccgggcaaattgtaaatcaaccaagtctgcttgcactcgatctcgggggtttacagataactgggagatcagactaaatttttaaaatttaggaaccaggggcggaagctgtttccgagtcaccatggatggacatgagttgctgccatttttaaaaaaatgtcccttccggaggctgaactagcttgcggttctggggcaatgtcatctctttcttgagatgggttaggatgtattccattgagtaatcacgctgccagttacccaaaacgctgaacttt

SEQ ID NO: 17451 - DNA, 529 bp, Zea mays
  Clone ID: LIB3279-005-P1-K1-B8.R2B
cggacgcgtgggcggacgcgtgggtgggcgtgcaactttcccttccttcgccgaagccgcgcgacggaaaccccaaacccaacctcatctcttttctcggcctctaccgccccctcgatcggtcggccggtcagctatgacgccgggaagctcggccgccggatccggcgtcgtcgttcctcggaacttcaggctcctagaagagcttgaacgtggagagaagggcattggagatgggacagtgagctatggaatggatgacgcagatgacatctacatgcgatcatggactggcactattattggccctcataataccgtccatgagggtcgcatctaccagctgaagttgttctgcgacaaggactaccctgagaagccaccatcagttcgatttcattcaagaataaacttaacatgcgttaatcatgaaactggagtggttgacccgaagagttcagcgttctgggtaactgccagcgggattactcaatggaatacatcctaacccatctcaagaaagagatga

SEQ ID NO: 17452 - DNA, 363 bp, Zea mays
  Clone ID: LIB3279-008-P1-K1-A1.F2B
acgaacaaaagtccatgattgggaaaaaatttgaaactccccaagtacatggcctcccttgctatacgaaccggaccgggaccccctgagatacaaacctggtgagacactttagttcttgccttaacagatctaaaagggcgggctgacccaaacaactgtgaaattccatcacatccaaattggacagcgaaaggggttccctatgaacaaacctgatggaattctaactagatacggcctaaattgtacactcaaagcgaccaaaagaagcctttactggccttgactccacttgagctcgaacgccaccataggcggtccgtatgctcctccgacaaatacgagaaggcttggacccgt

SEQ ID NO: 17453 - DNA, 369 bp, Zea mays
  Clone ID: LIB3279-008-P1-K1-A1.R2B
cccacgacctccgcgcgcgtcaagcgctggctcctcagagaggaggtgaacaacatattggcctgactacagctgcggacacggcgtgagcggcactagcgcctgaaccaatgggcggcgcggatagagggcgccagcttcccccgagtcccgatgagatactacgctctgttgcaagcccagccgacagtgcaggctctgggctgctacctgttcaaggtgcaaaacgagaagggcgcctttttactatgctggcaggagcgcgccatgttttacgtctcctcctggcgcgcacggagcttagagtggaggaggaacgcgttgacgccttcccgtctctgatcagaggatgacacggcccgaccgaca

SEQ ID NO: 17454 - DNA, 552 bp, Zea mays
  unsure (1)..(552): unsure at all n locations; Clone ID: LIB3279-008-P1-K1-H7.F2B
catcagttatatttgaagcttcgatgcacatcacacacacacggntccttgcagttgcgccacgacacgtagcgaattccatgtcatggctggaacaaaaccaaccacaaacgctccctgtccattccttggattgatctaacaaagtcccatcactgagaatctgagatcatccagcgctcacgtacaccttcgacagcgccgcggttgcgctaatcctttgccgaaacgcagcgagtttggcgccacgaccgtcgccagcgcacgcagcgacgacgacgggtccggggggattaggcggcccgtcgccgtcctcaggtgccctcagccgtagcttctgccacctctccttccttcacgtccatcgccagctcaggtggcctctgccagaagaccacgcgcacctgacctgacctaacaaaatcagttcggttgcgagtccaaccaccgcagcggctgccatcctcccaccacgtccccacgtctgcgtccgaggtcggccacatcatgtaccgcgctttccttaatcaagcgagaaagcacgaattcagc

SEQ ID NO: 17455 - DNA, 495 bp, Zea mays
  unsure (1)..(495): unsure at all n locations; Clone ID: LIB3279-008-P1-K1-H7.R2B
ccgacgcgtgggcggacgcgtggggtgtcgactactgcagggtttagtgtaccttcccgggtgtgtgtgcgtgtcgagcatggggcggacggtgtcgcacgagcaggccgtggagtggaaggtcctgagcgacgaccacacgccgcactgcctcgccttcatgttcgtcaactggtccttcatgtgagtgaggaccggccccctaacagagccagtcagtcacgcgcgcccgcccgcctagcatttgcagttgttatttgttgaactctgtatccaagtactggtcgctcttgcctttgttcaggcaattctgtgaaacgcacctgcccaccagtttatccgtggaacaaacgcctttagaagcggcttgcttgctatgttatgatggatcctggactgctgcatgtcctaaaaattggcttggaacattgcgtgcgtcaccttgtgctgaatttgntgcttctcgcttgattaaagaaagcgcggtacatgatg

SEQ ID NO: 17456 - DNA, 519 bp, Zea mays
  Clone ID: LIB3279-010-P1-K1-H4.F2B
agagcacaaatcaaatccagtcacaactagcatggtgtgaagtttatcacatatgtggactaggaatccaagctcggccttgaattcggtacatctgtgacacttacacagtaaccaccacagcacaggacgcatggatctcacatcttacatacgtgtgtatatatatatatagttacagcagcttacaagcgactcattctcaacgggcgactcatcttccatgggcacttcatgagcaccagttccagcagccaaacgacggcggcacccggccggtcctcctgatgtgctctgcctgctcagcggtcctcgcggctgcgcggttccgtttcagctccgccgcggcacgcttctcgtctgcgctgtgcctcgccgacgcgagcttggtcatcagcttgtcttgcgcgcgggcacgcatccgctccacctcgacctcgattttcctcatctcagcttctatctgggctttctgatggtcctcccaagcctggatcttgatctctttcgacgcgtggg

SEQ ID NO: 17457 - DNA, 519 bp, Zea mays
  Clone ID: LIB3279-010-P1-K1-H4.R2B
cccacgcgtccgaagagatcaagatccaggcttgggaggaccatcagaaagcccagatagaagctgagatgaggaaaatcgaggtcgaggtggagcggatgcgtgcccgcgcgcaagacaagctgatgaccaagctcgcgtcggcgaggcacagcgcagacgagaagcgtgccgcggcggagctgaaacggaaccgcgcagccgcgaggaccgctgagcaggcagagcacatcaggaggaccggccgggtgccgccgtcgtttggctgctggaactggtgctcatgaagtgcccatggaagatgagtcgcccgttgagaatgagtcgcttgtaagctgctgtaactatatatatatatacacacgtatgtaagatgtgagatccatgcgtcctgtgctgtggtggttactgtgtaagtgtcacagatgtaccgaattcaaggccgagcttggattcctagtccacatatgtgataaacttcacaccatgctagttgagactggatttgatttgtgctct

SEQ ID NO: 17458 - DNA, 544 bp, Zea mays
  unsure (1)..(544): unsure at all n locations; Clone ID: LIB3279-014-P1-K1-E9.F2B
gcggtataacatctagaatgcttaattaaaacagcagcaatggcagcttcatcgcatacaccggcgcgacgacgacgacgatcgtcgcgccgacgacaacgacaacacaaggtatactagaagataatctatcagaatcgaggacgacggttctggttctggtcactcctcaacatcagcagcagcaggtcgtgagactgaatccatcttactgaccctccgcagattctttcggggcagcagcatccttgatctcgtcgccgccatcctcgttggtgtcggaagtccatagggtcaagttgtcgcgcaggagctgcatgatcagagtgctgtccttgtaggactcctctcccaggctgtctagctcagagatcgcctcatcgaaggcctgcaacaaagattaaatttacttcaagccaactgcatccaatataaagcccaagatgcttaaattgatggggaacgtcaagagtacttcgttgcatanggaatgcatctgtcatctcaagtactgtatgaagaccgtcatgttcaacttcatgga

SEQ ID NO: 17459 - DNA, 567 bp, Zea mays
  unsure (1)..(567): unsure at all n locations; Clone ID: LIB3279-014-P1-K1-E9.R2B
caggatcctctgcgccacccacaaccgtgtgaccgtccgtgctgccggcgacccctatccgccgacccgtccgtcccaccacaccccaccgccgctcgcagctatgtcgccgtcggagccgacgcgggaggagagcgtgtacatggccaagctggcagagcaggcggagcggtacgaggagatggtcgagttcatggagcgcgtcgcgcgctccgccggcggcgccggcggaggggaggagctctccgtggaggagcgcaacctgctgtccgtcgcctacaagaacgtcatcggcgcccgcagggcctcgtggcggatcatctcctccatcgagcagaaggaggagggccgcgggaacgaggcgcacgccgtctccatccgcgcctaccgctccaagatcgagaccgagctcgcccgcatctgcgacggcatcctcgccctgctcgactcccacctngtcccatccgccggcggcgccgagtccaaggtcttctacctcaagatgaagggtgactaccacaggtaccttgctgagttcaagtctggtgcanagaggaaggatgctgc

SEQ ID NO: 17460 - DNA, 559 bp, Zea mays
  Clone ID: LIB3279-015-P1-K1-C4.F2B
cttgacttctagcatcaaagcaagcttatattagcatgtgttacatgctatcaaagatttatgacggttgcctaaaaccccacacacgtctccaaattaaacgactacgaagcatatgcgtccggtgatcatgagagataattaacttagaacaacatcatcactccaccgcatcgactacagcagcagccgatcgatcgatagatcgcgatcgaacgatcaactacacctagctatagctacaaagcaagcaacacgacaatcgtcgccaagattaacattatcctttggttggtttgtcgtcctcactagctctctctcccccggccggccctaactggctctacctgcaagctctgttcttgatgacgaacgacacaccatgcatgcgcccatgcacgactcatatatgcatgaatggacacatgcgcgtgtggcgccgttgtatgcggcggccggcgatcaccattcatcagcgccgccgtcaccagctgtggccctattattgctcctgcggtgccctgggggcgtgtgacccagagcgagctcatcgtgcgga

SEQ ID NO: 17461 - DNA, 540 bp, Zea mays
  Clone ID: LIB3279-015-P1-K1-C4.R2B
cttccccaacagtggcatcctcgctgaccaggtgtcgccggcaaaggcgtccccatcggcggcatcgacggcctcagctcagaggcggcgatgttcgacgtggagtacgggcggtggcaggaggagcactaccggctgatgtacgagcttcgggcggcgctgcagcagcacctgccggagggggagctgcagatgtacgtggagagctgcctggcgcaccacgacgagatggtgggcatcaaggagggcgccatcaagggcgacgtcttccacctcatctccggcgtctggcggagccccgccgagcgctgcttcctctggctcggcggcttccgcccctccgaagtcatcaagatgctgctgagccacgtagagcccctgaccgaacagcagatcgtgggcgtgtacgggctgcagcagtcggcgctggacacggaggaagcgctgagccagggcctggaggcgctctaccagtcgctgtctgacaccgtggtctccgacgcgctcagctgcccctcgaacgtctacaactacatgggt

SEQ ID NO: 17462 - DNA, 95 bp, Zea mays
  Clone ID: LIB3279-015-P1-K1-C5.R2B
gcggatccgcaaatggggaactggggatccaatttgaattgggcagaatgattggagctcgccctagcttgatttgtgggggcgggggggggggg

SEQ ID NO: 17463 - DNA, 550 bp, Zea mays
  Clone ID: LIB3279-059-P1-K1-G2.F2B
aggagaaaatagaaccaaatgcttgtattattcttcttttttgactaattaaacagttctcaataaactaacacagctgacatctaacatcaggatgaaatataacaattgtgggaaaagatcttcctgcagtgctatcgattttaatgggaaaaatgactaagcgctacgacccatactgtccctcagcttcttaacaatgtcctaaagtttctgataacagaaaaggagaacaaaatggaagagctgataaatccaggccaacggcaccaatgtcagtggccacctctatcatactcatcatctagagctcgtcgtgctcctcagagtccttgtcatcctcggcatcagagtcggccttgtcatcgtctgccttgtcatcgtctgcctcatcctctaggtcatcatcgtcatcatcgccacccttggcggcttcctcttcttccttctttttctcagcctcatcgaaagcagtcttctctgcctccttgtgcttgccccatgtcttctctgcaaaagtcttgccaacgcaggatcatcagtgatgatg

SEQ ID NO: 17464 - DNA, 455 bp, Zea mays
  Clone ID: LIB3279-059-P1-K1-G2.R2B
caggacgcgtgggcggacgcgtgggcggacgcgtgggcacgaccctgggaccggggctcagatcggatcgcatcagatcgaaggcgtccagaattttccatcgggcgtcggcggtgtggcgatccgcaggggttcttcgtacgccgtcgcggcacttctcgcgctcgcctgtgtcgccgccgtcgccggcgaggtattcttccaggagaagctcgaagatggctgggaaagtcggtgggtcaagttcgagtggaaaaaggacgataacatggctggtgaatggaaccacacctcggggaaatggagtggagatgcagaggacaaaggtattcaaacctccgaggactacaggttctatgccatttcagctgaataccctgaattcagcaacaaggataagaccctgggtgctgcagttctctgggaagcacgagcagaagcttgactggggtggt

SEQ ID NO: 17465 - DNA, 1392 bp, Zea mays
  Clone ID: LIB3279-044-F5_FLI
cggacgcatgggtcccacaccaccaccacctcctccggtccccaacccctgtcgcaccgcagccgccggccatggcctgcctcaccgacctcgtcaacctcaacctctcggacaacaccgagaagatcatcgcggaatacatatggatcggtggatctggcatggatctcaggagcaaagcaaggaccctctccggcccggtgaccgatcccagcaagctgcccaagtggaactacgacggctccagcacgggccaggcccccggcgaggacagcgaggtcatcttgtacccgcaggccatcttcaaggacccattcaggaggggcaacaacatccttgtgatgtgcgattgctacaccccagccggcgagccaatccccaccaacaagaggtacaacgccgccaagatcttcagcagccctgaggtcgccgccgaggagccgtggtatggtattgagcaggagtacaccctcctccagaaggacaccaactggccccttgggtggcccatcggtggcttccccggccctcagggtccttactactgtggaatcggcgccgaaaagtcgttcggccgcgacatcgtggacgcccactacaaggcctgcttgtatgcgggcatcaacatcagtggcatcaacggggaggtgatgccagggcagtgggagttccaagtcgggccttccgtgggtatatcttcaggcgaccaggtctgggtcgctcgctacattcttgagaggatcacggagatcgccggtgtggtggtgacgttcgacccgaagccgatcccgggcgactggaacggcgccggcgcgcacaccaactacagcacggagtcgatgaggaaggagggcgggtacgaggtgatcaaggcggccatcgagaagctgaagctgcggcacagggagcacatcgcggcatacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagggctaaggcggccgttccgtcgcgttgcgttgcgttgcagggtccccgaagcgattgcaaagccattgttccttctgttccgtttgcttattattatcattattatcatctagctagatcatccgggggtcaggtcgtcgtggtgtgccaaaacagaacacagaaagaagaagaaaaaaaaacaagacgtgtggcgttaatgttatgtcatccaataatggccgtaccacacttgtggtacctttcagt

SEQ ID NO: 17466 - DNA, 525 bp, Zea mays
  Clone ID: LIB3279-018-F2_FLI
ctcctcgcatttcttcccatcccccttcgcaacccaaaccccaactcgccccgcatcgatggcgcccaaggccgagaagaagcccgcggcgaagaagccggcggaggaggagcccgcggccgagaaggcgcccgccgggaagaagccgaaggcggagaagcgggtccccgctggcaagtccgctgccaaggagggcggcgagggcaagaggggcaagaagaagggcaagaagagcgtggagacctacaagatctacatcttcaaggtgctgaagcaggtgcacccggacattggcatctcctccaaggccatgtcgatcatgaactccttcattaacgatatcttcgagaagctcgcttgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggcctaggctgcgcggccgc

SEQ ID NO: 17467 - DNA, 509 bp, Zea mays
  Clone ID: LIB3279-005-E7_FLI
ggagcaaccgcttgcgtcacacgcacactgacggagagtgatcactgatttctggtcatggcaaccgtaactgaggaagttgctccggtcgtcaccgtctccgaggagccggcgccggaggcggcgaaggaggtggcggagaagccggaggaggggaagaagcccgacgaggagggtggcgaggggaagaaggccgcccccgccgccgagaaggagaagaaggcgaggaagccgcggagcaggaagcccaagtccgccgggccgcaccacccgccctacttcgagatgatcaaggaggcgatcctgtcgcaggacggcgggaaggtcggggcgagcccgtacgcgatcgccaagcacatgggggagaagcaccgggacgtgctcccgcccaattaccgcaaggtgctggcagtgcagctgcgcggcttcgccgccaagggccgcctcgtcaaggtcaaggcttccttcaagctcgccgccgccgaggagaggaagccctccgcggccgc

SEQ ID NO: 17468 - DNA, 710 bp, Zea mays
  Clone ID: LIB3279-017-A2_FLI
gcggaaggagtcggagggaaccgaaaactcagggtctcgaatttcctaggagcggaggcgatggctgggaagggaggaaaaggattgctcgccgcgaagacgacggcggccaagtcggcggagaaggacaaggggaagaaggcccccatctcacggtcctcccgcgcgggcctccagtttcctgttggacgaatccaccgtcagctgaagcaaaggactcaggcaaatggccgcgttggtgccactgcagccgtctactctgccgccatcctggagtacttgactgccgaggttttggagctggccgggaacgctagcaaggatctgaaggtgaagcgtatcacccctcgccacctacagttggccattcgcggagacgaggagctggacaccctcatcaagggcaccatcgcaggtggaggcgtcatcccgcacatccacaagtccctgatcaacaagtcctccaaggagtgaagactagggaatgcacattgttagtttaaactggacatttctgtgtgctcctctgcgagtccttgtcgtcgtgtaggttttagttgagctgtcaggttggagtgacccttctcctgtgtaacgcttgcctggtactgcttcagttatttggacactgtttgtgttgagttgttaacttcaagggtgcaaacctggataattatttagttattatatgactatctggtatccggttt

SEQ ID NO: 17469 - DNA, 644 bp, Zea mays
  Clone ID: LIB3279-059-H8_FLI
gcctcattcatctccattcgaaacaccctcgcacccacactctcccttcgtccccagcctaaatccccgcaacgatggctcgcacgaagcagacggcgcgcaagtccacgggcggcaaggccccgaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgcccttccagcgcctggtccgcgagatcgcgcaggacttcaagaccgacctccgcttccagtcctccgccgtcgccgcgctgcaggaggccgccgaggcctacctcgtcggcctgttcgaggacaccaacctctgcgccatccacgccaagcgcgtcaccatcatgcccaaggacatccagctcgcccgccgcatccgcggggagcgcgcctaggcggccggccggataggccgtggcccgtggcgcaggctcttctcggaagtttgtactagtggtcgggtcgtgtggaaggagtggtgtactgatcagcaatgtctcaaaccatgtcaacctctttgttgtcatcaatggaaatcgccacttatgtgtgct

SEQ ID NO: 17470 - DNA, 713 bp, Zea mays
  Clone ID: LIB3279-057-D4_FLI
gacattgagcaagtaaaagctgatgctgagggcctggcaaagaaactggaagcacttgaagcttacaaaagaaaacttttgggtgagaggttggaagaatgctcctttgaagaactgcacagtttggaagtgaaactcgaaaagagccttcattgcatcaggggaagaaagactcagctgctggaggagcaactccataagctgaaggagaaggagatgaatctgcgcaagagcaacgaagatttacgtgaaaagtgcaagaagcagccgccgccgccgccgcctatgctgatggctcctccgccgcctccagcgccggcagccatcgatcacacggggccgaaggatgtcgggatggacgtggagacggagctgtacataggattgcccggcagagattaccgctcaaacaacaaagacatgactgcacagtagctgtcaggtcaggtcaggtcaggctagccagcagtgcagagaataatcttagatctgtggtgcggagaactggagatgcaagccaagcccaagccaatcaacatgataaggatcatgagtgtcgcgtcgtgttttacaaacctgtccaccgtccgtcaaaggcacatgcgccagaacgtccgtcagagaacacttaccccctcatctccctctattagctagctgctccggcctgctcatgtcgaaaccttctgttcaagtatgttctcctcctgatg

SEQ ID NO: 17471 - DNA, 1094 bp, Zea mays
  Clone ID: LIB3279-060-A7_FLI
gtggcatggcacaggttttgaacacggctccagtagcaccagcaaatctccctatgccaaatccagcaccggcaatttcatctgtggcgccttcagaacaatctgcacccagcaaggaggatgttgaattagcaatggctatcaatgcctccattcaatcagctattgcagagggagtatcagtgcccaatgttcaaccaaatgcatccacccccaacaacaatggctgggctgcccctccaagtaattctcacaacggatggggaccaccagccactcctgcaccatcaaagacgagcggtcagtcccaggtccgggtagacgccccaagcagcagcacttacaatggatgggatgtgcccggaacaagctctagtcaaagttcatcgaaaccccaccaaacccaaaccaaccctcctccagtcttgattccacaggaagcacttcaggctctcccaaccccaaccgcgccaccgtttgctgaagaaaccttctacaacggtcctgttcactatccatccatagactctacgcctgtcgatgtaaccatgccggctaccactggaggcggtagtacaacagtcatcgcaacggcagcacctacagaacagttagaaaatgaagctgatgcaagtgacagcggcaaaactccctctggtacttgcgttatatgtctggatgcccctgtggaaggtgcctgcatcccgtgcggccacatggctggttgcatgtcctgtttgaaggacatagaatccaagaagtggggatgccctatctgccgtgccacgattaaccaggttgttcgcctctatgctgtttgaggagttgaaacggtgggttcagaaagttggcaatggattggagggttctcgcaacaaatgttgatgggaacgtctctatctcaaaattgtgcaattatgctatttttgcacttcgtactgcactacaaatatgacttccgtgtaatgtatgtggctgacgcctttatgtacataggtagtactatacaagacaattctataaaaatctgggtattgttgcaagttgcaactcacgttcaaagttgcacgattgtggagcttttccaataaaaa

SEQ ID NO: 17472 - DNA, 1396 bp, Zea mays
  Clone ID: LIB3279-057-D9_FLI
gtctcctctccccatcttctctcctggaagccgcctcggtcggacccggacaagatggccgccttcttcggtgctgcaccgccgccggctctcgcttcgttccgccacgaggaggaggaggagcagcatcaggacgccgccgaggaggtgtaccacgtggacgatgtcgacgagggcagcggtgacggccgtggccacggcggcgccggccaggggaagctgtgcgccaggggccactggcgccccgccgaggacgccaagctcaaggagctcgtcgcgcagttcgggccccagaactggaacctcatcgccgagaggctggacggcagatcagggaagagctgccgcctgcggtggttcaaccagctggacccgcggatcaaccggcgcgccttctcggaggaggaggaggagcggctcctggcggcgcaccgcgcgtacggcaacaagtgggctctcatcgcgcgcctcttcccgggccgcaccgacaacgccgtcaagaaccactggcacgtcctcatggcgcgcaggcagcgggagcactcgggcgcgctccgccgccgcaagccctcctcgacctcgccctcgccggcgccggcgccggcgccgcacctggcgcccgtcgtcgtcctccaccaccaccaccactacgccggcggctcccctcccatgccgccgttgcacgccgccgacgcccacacgcagtacacggcagcggcggcggcagcggacacccgcgcgcacagcggcggcgagtccgacgagaccgcctccacgtgcaccaccgacctctccctcgcttccgccgccccctgcttctaccagagtggctacgacgtggccccgcgcgccgcggcgttcgcaccgagcgcgcgctccgccttctccgcgccgccggcgacggcgcgctccgacgacaaggtctcgctgcccttcttcgacttcctcggcgtcggcgcggcgtgatgggggggccggcccgggccggccaggcggcggtgtacaggagggcggaggcggtcaaaggacgagagccccggcggcggtgaacccgtgcccgcgcgtagtttagctttagagcccgagttaaatcatcgagaacagaacatggcctgagcctgagagaggaggagaatggcgatccaccattgaactggtgcccgtggcattgcagactaacagctccgcatccgttcggctgctgatgttgctagtagtaatggtacggtgattactctctgctttgggttgggagagacgaatctgcaagcaccaccagaccaagcaagggcgacgatgggtatgggtggatgtttgcagaagaagaaaaaaccgcttgtaacacaaactgcaggacaaaggcagatcagagatcctctgctaactctctttttac
